US011814413B2

(12) United States Patent
Haynes et al.

(10) Patent No.: US 11,814,413 B2
(45) Date of Patent: Nov. 14, 2023

(54) COMPOSITIONS COMPRISING MODIFIED HIV ENVELOPES

(71) Applicant: Duke University, Durham, NC (US)

(72) Inventors: Bar

(56) References Cited

OTHER PUBLICATIONS

Blattner, C., et al., "Structural delineation of a quaternary, cleavage-dependent epitope at the gp41-gp120 interface on intact HIV-1 Envtrimers.," Immunity, vol. 40, No. 5, pp. 669-680, Author Manuscript—25 total pages (May 15, 2014).
Bolton, D. L., et al., "Human Immunodeficiency Virus Type I Monoclonal Antibodies Suppress Acute Simian-Human Immunodeficiency Virus Viremia and Limit Seeding of Cell-Associated Viral Reservoirs," Journal of Virology, vol. 90, No. 3, pp. 1321-1332 (Feb. 2016).
Bonomelli, C., et al., "The glycan shield of HIV is predominantly oligomannose independently of production system or viral clade," PloS ONE, vol. 6, Issue 8, e23521, pp. 1-7 (Aug. 2011).
Bonsignori, M., et al., "Analysis of a clonal lineage of HIV-1 envelope V2/V3 conformational epitope-specific broadly neutralizing antibodies and their inferred unmutated common ancestors," Journal of Virology, vol. 85, No. 19, pp. 9998-10009 (Oct. 2011).
Bonsignori, M., et al., "Maturation pathway from germline to broad HIV-1 neutralizer of a CD4-mimic antibody," Cell, vol. 165, No. 2, pp. 449-463 (Apr. 2016).
Bonsignori, Mattia, et al., "Two distinct broadly neutralizing antibody specificities of different clonal lineages in a single HIV-1—infected donor: implications for vaccine design," Journal of Virology, vol. 86, No. 8, pp. 4688-4692 (Apr. 2012).
Bosch, V., et al., "Mutational Analysis of the Human Immunodeficiency Virus Type 1 envGene Product Proteolytic Cleavage Site," Journal of Virology, vol. 64, No. 5, pp. 2337-2344 (May 1990).
Bradley, T. et al., "Structural Constraints of Vaccine-Induced Tier-2 Autologous HIV Neutralizing Antibodies Targeting the Receptor-Binding Site," Cell Reports, vol. 14, No. 1, pp. 43-54, Author Manuscript—26 total pages (Jan. 5, 2016).
Burton, D. R., et al., "Efficient neutralization of primary isolates of HIV-1 by a recombinant human monoclonal antibody," Science, vol. 266, No. 5187, pp. 1024-1027 (Nov. 11, 1994).
Bussow, K., "Stable mammalian producer cell lines for structural biology" Current Opinion in Structural Biology, vol. 32, No. 81-90 (2015).
Cany, J., et al., "AFP-specific immunotherapy impairs growth of autochthonous hepatocellular carcinoma in mice," Journal of Hepatology, vol. 54, pp. 115-121 (2011).
Cao, L., et al., "Global site-specific N-glycosylation analysis of HIV envelope glycoprotein," Nature Communications, vol. 8, No. 14954, pp. 1-13, DOI: 10.1038/ncomms14954 (Mar. 28, 2017).
Caskey, M., et al., "3BNC117 a Broadly Neutralizing Antibody Suppresses Viraemia in HIV-I-infected Humans," Nature, vol. 522, No. 7557, pp. 487-491, Author Manuscript—29 total pages (Jun. 25, 2015).
Center, Rob J., et al., "Oligomeric structure of the human immunodeficiency virus type 1 envelope protein on the virion surface," Journal of Virology, vol. 76, No. 15, pp. 7863-7867 (Aug. 2002).
Chakrabarti, B. K., et al., "Modifications of the Human Immunodeficiency Virus Envelope Glycoprotein Enhance Immunogenicity for Genetic Immunization," Journal of Virology, vol. 76, No. 11, pp. 5357-5368 (Jun. 2002).
Chang, V. T., et al., "Glycoprotein Structural Genomics: Solving the Glycosylation Problem," Structure, vol. 15, No. 3, pp. 267-273 (15 total pages) (Mar. 2007).
Chen, C., et al., "The site and stage of anti-DNA B-cell deletion," Nature, vol. 373, pp. 252-255 (Jan. 19, 1995).
Corti, D., et al., "Analysis of memory B cell responses and isolation of novel monoclonal antibodies with neutralizing breadth from HIV-I-infected individuals," PloS ONE, vol. 5, Issue 1, pp. 1-15 (Jan. 2010).
Dal Porto, J. M., et al., "Very low affinity B cells form germinal centers, become memory B cells, and participate in secondary immune responses when higher affinity competition is reduced," The Journal of Experimental Medicine, vol. 195, No. 9, pp. 1215-1221 (May 6, 2002).
De Taeye, Steven W., et al., "Immunogenicity of stabilized HIV-1 envelope trimers with reduced exposure of non-neutralizing epitopes," Cell., vol. 163, No. 7, pp. 1702-1715—(Dec. 17, 2015).
DeCamp, A., et al., "Global panel of HIV-1 Env reference strains for standardized assessments of vaccine-elicited neutralizing antibodies," Journal of Virology, vol. 88, No. 5, pp. 2489-2507 (Mar. 2014).
Paus, Didrik, et al., "Antigen recognition strength regulates the choice between extrafollicular plasma cell and germinal center B cell differentiation," The Journal of Experimental Medicine, vol. 203, No. 4, pp. 1081-1091 (Apr. 17, 2006).
Diskin, R., et al., "Restricting HIV-1 pathways for escape using rationally designed anti-HIV-1 antibodies," Journal of Experimental Medicine, vol. 210, No. 6, pp. 1235-1249 (2013).
Diskin, R., et al., "Increasing the potency and breadth of an HIV antibody by using structure-based rational design," Science, vol. 334, No. 6060, pp. 1289-1293, Author Manuscript—10 total pages (Dec. 2, 2011).
Doores, K. J., et al., "Envelope glycans of immunodeficiency virions are almost entirely oligomannose antigens," Proceedings of the National Academy of Sciences of the United States of America, vol. 107, No. 31, pp. 13800-13805 (Aug. 3, 2010).
Eggink, D., et al., "Lack of complex N-glycans on HIV-1 envelope glycoproteins preserves protein conformation and entry function," Virology, vol. 401, No. 2, pp. 236-247, Author Manuscript—25 total pages (Jun. 5, 2010).
Falkowska, E., et al. "Broadly Neutralizing HIV Antibodies Define a Glycan-Dependent Epitope on the Prefusion Conformation of gp41 on Cleaved Envelope Trimers", Immunity, vol. 40, pp. 657-668 (May 15, 2014).
Gao, F., et al., "Antigenicity and Immunogenicity of a Synthetic Human Immunodeficiency Virus Type 1 Group M Consensus Envelope Glycoprotein," Journal of Virology, vol. 79, No. 2, pp. 1154-1163 (Jan. 2005).
Gao, F., et al., "Cooperation of B cell lineages in induction of HIV-1-broadly neutralizing antibodies," Cell, vol. 158, No. 3, pp. 481-491 (Jul. 31, 2014).
Gautam, R., et al., "A single injection of anti-HIV-1 antibodies protects against repeated SHIV challenges," Nature, vol. 533, No. 7601, pp. 105-109, Author Manuscript—21 total pages (May 5, 2016).
GenBank Accession Nos. KC247375-KC247667, last downloaded from https://www.ncbi.nlm.nih.gov/nucore on May 12, 2020 (33 total pages).
GenBank Accession Nos. KC575845-KC576303, last downloaded from https://www.ncbi.nlm.nih.gov/nucore on May 14, 2020 (86 total pages).
GenBank Accession Nos. KU570032-KU570053, last downloaded from https://www.ncbi.nlm.nih.gov/nucore on May 14, 2020 (5 total pages).
Geyer, H., et al., "Carbohydrates of human immunodeficiency virus. Structures of oligosaccharides linked to the envelope glycoprotein 120," The Journal of Biological Chemistry, vol. 263, No. 24, pp. 11760-11767 (Aug. 25, 1988).
Go, E. P., et al., "Characterization of host-cell line specific glycosylation profiles of early transmitted/founder HIV-1 gp120 envelope proteins," Journal of Proteome Research, vol. 12, No. 3, pp. 1223-12234, Author Manuscript—22 total pages (Mar. 1, 2013).
Go, E. P., et al., "Glycosylation site-specific analysis of HIV envelope proteins (JR-FL and CON-S) reveals major differences in glycosylation site occupancy, glycoform profiles, and antigenic epitopes' accessibility," Journal of Proteome Research, vol. 7, No. 4, pp. 1660-1674, Author Manuscript—25 total pages (Apr. 2008).
Go, E.P., et al., "Comparative Analysis of the Glycosylation Profiles of Membrane-Anchored HIV-1 Envelope Glycoprotein Trimers and Soluble gp14 0," Journal of Virology, vol. 8 9, No. 16, pp. 8245-8257 (Aug. 2015).
Goepfert, P.A., et al., "Specificity and 6-Month Durability of Immune Responses Induced by DNA and Recombinant Modified Vaccinia Ankara Vaccines Expressing HIV-1 Virus-Like Particles," The Journal of Infectious Disease, vol. 210, Issue 1, pp. 99-110 (Jul. 1, 2014).
Gorman, J., et al., "Structures of HIV-1 Env V1V2 with broadly neutralizing antibodies reveal commonalities that enable vaccine

(56) References Cited

OTHER PUBLICATIONS design," Nature Structural and Molecular Biology, vol. 23, No. 1, pp. 81-90, Author Manuscript—34 total pages (Jan. 2016).
Graham, B. S., et al., "DNA Vaccine Delivered by a Needle-Free Injection Device Improves Potency of Priming for Antibody and CD8+ T-Cell Responses after rAd5 Boost in a Randomized Clinical Trial," Public Library of Science ONE, vol. 8, No. 4, pp. 1-11 (Apr. 2013).
Gristick, H. B., et al., "Natively glycosylated HIV-1 Env structure reveals new mode for antibody recognition of the CD4-binding site," Nature Structural & Molecular Biology, vol. 23, No. 10, pp. 906-915, Author Manuscript—24 total pages (Oct. 2016).
Guo, H.-G., et al., "Characterization of an HIV-1 Point Mutant Blocked in Envelope Glycoprotein Cleavage," Virology, vol. 174, pp. 217-224 (1990).
Harris, A., et al., "Trimeric HIV-1 glycoprotein gp140 immunogens and native HIV-I envelope glycoproteins display the same closed and open quaternary molecular architectures," Proceedings of the National Academy of Sciences of the United States of America, vol. 108, No. 28, pp. 11440-11445 (Jul. 12, 2011).
Haynes, B. F., et al., "B-cell-lineage immunogen design in vaccine development with HIV-1 as a case study," Nature Biotechnology, vol. 30, No. 5, pp. 423-433 (May 7, 2012).
Haynes, B. F., et al., "Host controls of HIV neutralizing antibodies," Science, vol. 344, No. 6184, pp. 588-589, Author Manuscript—5 total pages (May 9, 2014).
He, L., et al., "Presenting native-like trimeric HIV-1 antigens with self-assembling nanoparticles," Nature Communications, DOI: 10.1038/ncomms12041, pp. 1-15 (2016).
Hoot, S., et al., "Recombinant HIV envelope proteins fail to engage germline versions of anti-CD4bs bNAbs," PLoS Pathogens, vol. 9, Issue 1, pp. 1-14 (Jan. 2013).
Horwitz, J. A., et al., "HIV-1 suppression and durable control by combining single broadly neutralizing antibodies and antiretroviral drugs in humanized mice," Proceedings of the National Academy of Sciences of the United States of America, vol. 110, No. 41, pp. 16538-16543 (Oct. 8, 2013).
Huang, J., et al., "Broad and potent neutralization of HIV-1 by a gp41-specific human antibody," Nature, vol. 491, No. 7424, pp. 406-412, Author Manuscript—22 total pages (Nov. 15, 2012).
Huang, J., et al., "Identification of a CD4-Binding-Site Antibody to HIV that Evolved Near-Pan Neutralization Breadth," Immunity, vol. 45, pp. 1108-1121 (Nov. 15, 2016).
International Search Report and Written Opinion, dated Oct. 12, 2018, for International Application No. PCT/US2018/034772 (14 pages).
Jardine, J. G., et al., "HIV-1 broadly neutralizing antibody precursor B cells revealed by germline-targeting immunogen," Science, vol. 351, Issue 6280, pp. 1458-1463 (Mar. 25, 2016).
Jardine, J. G., et al., "Priming a broadly neutralizing antibody response to HIV-1 using a germline-targeting immunogen," Science, vol. 349, No. 6244, pp. 156-161, Author Manuscript—20 total pages (Jul. 10, 2015).
Jardine, J., et al., "Rational HIV immunogen design to target specific germline B cell receptors," Science, vol. 340, No. 6133, pp. 711-716, Author Manuscript—13 total pages (Mar. 10, 2013).
Julien, J.-P., et al., "Design and structure of two HIV-1 clade C SOSIP.664 trimers that increase the arsenal of native-like Env immunogens," PNAS, vol. 112, No. 38, pp. 11947-11952 (Sep. 22, 2015).
Kepler, T. B., et al., "Somatic Hypermutation in B Cells: An Optimal Control Treatment," Journal of Theoretical Biology, vol. 164, pp. 37-64 (1993).
Kibler, Karen V., et al., "Improved NYVAC-based vaccine vectors," Public Library of Science ONE, vol. 6, No. 11, pp. 1-13 (Nov. 2011).
Klein, F., et al., "Enhanced HIV-I immunotherapy by commonly arising antibodies that target virus escape variants," Journal of Experimental Medicine, vol. 211, No. 12, pp. 2361-2372 (2014).
Klein, F., et al., "HIV therapy by a combination of broadly neutralizing antibodies in humanized mice," Nature, vol. 492, No. 7427, Author Manuscript—14 total pages (Dec. 6, 2012).
Ko, Sung-Youl, et al., "Enhanced neonatal Fc receptor function improves protection against primate SHIV infection," Nature, vol. 514, No. 7524, pp. 642-645, Author Manuscript—22 total pages (Oct. 30, 2014).
Kong, R., et al., "Fusion peptide of HIV-1 as a site of vulnerability to neutralizing antibody," Science, vol. 352, No. 6287, pp. 828-833, Author Manuscript—12 total pages (May 13, 2016).
Kwon, Y. D., et al., "Crystal structure, conformational fixation and entry-related interactions of mature ligand-free HIV-1 Env," Nature Structural & Molecular Biology, vol. 22, No. 7, pp. 522-531, Author Manuscript—30 total pages (Jul. 2015).
Leonard, C. K., et.al., "Assignment of intrachain disulfide bonds and characterization of potential glycosylation sites of the type 1 recombinant human immunodeficiency virus envelope glycoprotein (gp120) expressed in Chinese hamster ovary cells," The Journal of Biological Chemistry, vol. 265, No. 18, pp. 10373-10382 (Jun. 25, 1990).
Li, M., et al., "Human immunodeficiency virus type 1 env clones from acute and early subtype B infections for standardized assessments of vaccine-elicited neutralizing antibodies," Journal of virology, vol. 79, No. 16, pp. 10108-10125 (Aug. 2005).
Li, Y., et al., "Control of Expression, Glycosylation, and Secretion of HIV-1 gp120 by Homologous and Heterologous Signal Sequences," Virology, vol. 204, Issue 1, pp. 266-278 (Oct. 1994).
Li, Y., et al., "Effects of inefficient cleavage of the signal sequence of HIV-1 gp120 on its association with calnexin, folding, and intracellular transport," Proceedings of the National Academy of Sciences of the United States of America, vol. 93, pp. 9606-9611 (Sep. 1996).
Li, Y., et al., "Mechanism of neutralization by the broadly neutralizing HIV-1 monoclonal antibody VRC01," Journal of virology, vol. 85, No. 17, pp. 8954-8967 (Sep. 2011).
Liao, H.-X., et al., "Co-Evolution of a Broadly Neutralizing HIV-1 Antibody and Founder Virus", Nature, vol. 496, No. 7446, pp. 469-476, Author Manuscript—25 total pages (Apr. 2013).
Liao, Hua-Xin, et al., "A group M consensus envelope glycoprotein induces antibodies that neutralize subsets of subtype B and C HIV-1 primary viruses," Virology, vol. 353, No. 2, pp. 268-282 (2006).
Liao, Hua-Xin, et al., "Antigenicity and immunogenicity of transmitted/founder, consensus, and chronic envelope glycoproteins of human immunodeficiency virus type 1," Journal of Virology, vol. 87, No. 8, pp. 4185-4201, 34 total pages (Apr. 2013).
Liao, Hua-Xin, et al., "Initial antibodies binding to HIV-1 gp41 in acutely infected subjects are polyreactive and highly mutated," Journal of Experimental Medicine, vol. 208, No. 11, pp. 2237-2249, DOI: 10.1084/jem.20110363, 13 total pages (Oct. 2011).
Lynch, R. M., et al., "HIV-1 fitness cost associated with escape from the VRC01 class of CD4 binding site neutralizing antibodies," Journal of Virology, vol. 89, No. 8, pp. 4201-4213 (Apr. 2015).
Mascola, J. R., et al., "HIV-1 neutralizing antibodies: understanding nature's pathways," Immunological Reviews, vol. 254, No. 1, pp. 225-244—Author Manuscript—29 total pages (Jul. 2013).
McCune, J. M., et al., "Endoproteolytic Cleavage of gp160 Is Required for the Activation of Human Immunodeficiency Virus," Cell, vol. 53, pp. 55-67 (Apr. 8, 1988).
McGuire, A. T., et al., "Engineering HIV envelope protein to activate germline B cell receptors of broadly neutralizing anti-CD4 binding site antibodies," Journal of Experimental Medicine, vol. 210, No. 4, pp. 655-663, DOI: 10.1084/jem.20122824 (2013).
McGuire, A. T., et al., "Specifically modified Env immunogens activate B-cell precursors of broadly neutralizing HIV-1 antibodies in transgenic mice," Nature Communications, vol. 7, No. 10618, pp. 1-10 (Feb. 24, 2016).
Meffre, E., et al., "Immunoglobulin heavy chain expression shapes the B cell receptor repertoire in human B cell development," The Journal of Clinical Investigation, vol. 108, No. 6, pp. 879-886 (Sep. 2001).
Montefiori, D.C., "Measuring HIV neutralization in a luciferase reporter gene assay," HIV Protocols: Second Edition, vol. 485, Chapter 26, pp. 395-405 (2009).

(56) References Cited

OTHER PUBLICATIONS

Moody, M.A., et al., "Toll-Like Receptor 7 /8 (TLR7 /8) and TLR9 Agonists Cooperate To Enhance HIV-1 Envelope Antibody Responses in Rhesus Macaques," Journal of Virology, vol. 88, No. 6, pp. 3329-3339 (Mar. 2014).
Morris, L., et al., "Isolation of a human anti-HIV gp41 membrane proximal region neutralizing antibody by antigen-specific single B cell sorting," Public Library of Science ONE, vol. 6, Issue 9, pp. 1-10 (Sep. 2011).
Mouquet, H., et al., "Complex-type N-glycan recognition by potent broadly neutralizing HIV antibodies," Proceedings of the National Academy of Sciences of the United States of America, pp. E3268-E3277, www.pnas.org/cgi/doi/10.1073/pnas.1217207109 (Oct. 30, 2012).
Mouquet, H., et al., "Polyreactivity increases the apparent affinity of anti-HIV antibodies by heteroligation" Nature, vol. 467, No. 7315, pp. 591-595, Author Manuscript—15 total pages (Sep. 30, 2010).
NCBI Sequence Reads Archive No. SRP067168, last downloaded from https://www.ncbi.nlm.nih.gov/ on May 12, 2020 (5 total pages).
Parren, P. W. H. I., et al., "Antibody Neutralization-Resistant Primary Isolates of Human Immunodeficiency Virus Type 1," Journal of Virology, vol. 72, No. 12, pp. 10270-10274 (Dec. 1998).
Perreau, M., et al., "DNA/NYVAC Vaccine Regimen Induces HIV-Specific CD4 and CD8 T-Cell Responses in Intestinal Mucosa," Journal of Virology, vol. 85, No. 19, pp. 9854-9862 (Oct. 2011).
Poignard, P., et al., "Heterogeneity of envelope molecules expressed on primary human immunodeficiency virus type 1 particles as probed by the binding of neutralizing and nonneutralizing antibodies. ," Journal of Virology, vol. 77, No. 1, pp. 353-365 (Jan. 2003).
Pritchard, L. K., et al., "Cell- and Protein-Directed Glycosylation of Native Cleaved HIV-1 Envelope," Journal of Virology, vol. 89, No. 17, pp. 8932-8944 (Sep. 2015).
Pritchard, L. K., et al., "Glycan clustering stabilizes the mannose patch of HIV-1 and preserves vulnerability to broadly neutralizing antibodies," Nature Communications, vol. 6. No. 7479, pp. 1-11, DOI: 10.1038/ncomms8479 (Jun. 24, 2015).
Pritchard, L. K., et al., "Glycan Microheterogeneity at the PGT135 Antibody Recognition Site on HIV-1 gp120 Reveals a Molecular Mechanism for Neutralization Resistance," Journal of Virology, vol. 89, No. 13, pp. 6952-6959 (Jul. 2015).
Pritchard, L. K., et al., "Structural Constraints Determine the Glycosylation of HIV-1 Envelope Trimers," Cell Reports, vol. 11, pp. 1604-1613 (Jun. 16, 2015).
Proft, T., "Sortase-mediated protein ligation: an emerging biotechnology tool for protein modification and immobilisation," Biotechnology Letters, vol. 32, No. 1, pp. 1-10 (Jan. 2010).
Protein Data Bank No. PDB ID 5F90, last downloaded from https://www.ncbi.nlm.nih.gov/ on May 15, 2020 (1 total page).
Protein Data Bank No. PDB ID 5F96, last downloaded from https://www.ncbi.nlm.nih.gov/ on May 15, 2020 (1 total page).
Protein Data Bank No. PDB ID 5F9W, last downloaded from https://www.ncbi.nlm.nih.gov/ on May 15, 2020 (2 total pages).
Reeves, P. J., et al., "Structure and function in rhodopsin: high-level expression of rhodopsin with restricted and homogeneous N-glycosylation by a tetracycline-inducible N-acetylglucosaminyltransferase I-negative HEK293S stable mammalian cell line," Proceedings of the National Academy of Sciences of the United States of America, vol. 99, No. 21, pp. 13419-13424 (Oct. 15, 2002).
Ringe, R. P., et al., "Influences on the Design and Purification of Soluble, Recombinant Native-Like HIV-1 Envelope Glycoprotein Trimers," Journal of Virology, vol. 89, No. 23, pp. 12189-12210 (Dec. 2015).
Rudicell, R. S., et al., "Enhanced Potency of a Broadly Neutralizing HIV-1 Antibody In Vitro Improves Protection against Lentiviral Infection In Vivo," Journal of Virology, vol. 88, No. 21, pp. 12669-12682 (Nov. 2014).
Sanders, R. W., et al., "A Next-Generation Cleaved, Soluble HIV-1 EnvTrimer, BG505 SOSIP.664 gp140, Expresses Multiple Epitopes for Broadly Neutralizing but not non-neutralizing Antibodies," PLOS Pathogens, vol. 9, Issue 9, 20 total pages (Sep. 2013).
Sanders, R. W., et al., "HIV-1 neutralizing antibodies induced by native-like envelope trimers," Science, vol. 349, Issue 6244, 13 total pages (Jul. 10, 2015).
Santra, S., et al., "Mosaic Vaccines Elicit CD8+ T lymphocyte Responses in Monkeys that Confer Enhanced Immune Coverage of Diverse HIV Strains," Nature Medicine, vol. 16, No. 3, pp. 324-328, Author Manuscript—13 total pages (Mar. 2010).
Saunders, K. O., et al., "Broadly Neutralizing Human Immunodeficiency Virus Type I Antibody Gene Transfer Protects Nonhuman Primates from Mucosal Simian-Human Immunodeficiency Virus Infection," Journal of virology, vol. 89, No. 16, pp. 8334-8345 (Aug. 15, 2015).
Saunders, K. O., et al., "Sustained Delivery of a Broadly Neutralizing Antibody in Nonhuman Primates Confers Long-Term Protection against Simianffluman Immunodeficiency Virus Infection," Journal of Virology, vol. 89, No. 11, pp. 5895-5903 (Jun. 2015).
Scharf, L., et al., "Structural basis for germline antibody recognition of HIV-1 immunogens," eLife, DOI: 10.7554/eLife.13783, pp. 1-24 (2016).
Scheid, J. F., et al., "Sequence and structural convergence of broad and potent HIV antibodies that mimic CD4 binding," Science, vol. 333, No. 6049, pp. 1633-1637, Author Manuscript—11 total pages (Sep. 16, 2011).
Schmohl, L., et al., "Sortase-mediated ligations for the site-specific modification of proteins," Current Opinion in Chemical Biology, vol. 22, pp. 122-128 (2014).
Seaman, M. S., et al., "Tiered categorization of a diverse panel of HIV-1 Env pseudoviruses for assessment of neutralizing antibodies," Journal of Virology, vol. 84, No. 3, pp. 1439-1452 (Feb. 2010).
Shih, Tien-An Yang, et al., "Role of BCR affinity in T cell-dependent antibody responses in vivo," Nature Immunology, vol. 3, No. 6., pp. 570-575 (Jun. 2002).
Shingai, M., et al., "Antibody-mediated immunotherapy of macaques chronically infected with SHIV suppresses viraemia," Nature, vol. 503, No. 7475, pp. 277-280, Author Manuscript—21 total pages (Nov. 14, 2013).
Shingai, M., et al., "Passive transfer of modest titers of potent and broadly neutralizing anti-HIV monoclonal antibodies block SHIV infection in macaques," The Journal of Experimental Medicine, vol. 211, No. 10, pp. 2061-2074 (2014).
Shiokawa, S., et al., "IgM Heavy Chain Complementarity-Determining Region 3 Diversity Is Constrained by Genetic and Somatic Mechanisms Until Two Months After Birth," Journal of Immunology, vol. 162(10), pp. 6060-6070 (May 1999).
Sliepen, K., et al., "Presenting native-like HIV-1 envelope trimers on ferritin nanoparticles improves their immunogenicity," Retrovirology, vol. 12, No. 82, pp. 1-5 (2015).
Sok, D., et al., "Recombinant HIV envelope trimer selects for quaternary-dependent antibodies targeting the trimer apex," Proceedings of the National Academy of Sciences of the United States of America, vol. 111, No. 49, pp. 17624-17629 (Dec. 9, 2014).
Tabata, A., et al., "Development of a Sortase A-mediated Peptide-labeled Liposome Applicable to Drug-delivery Systems," Anticancer Research, vol. 35, No. 8, pp. 4411-4417 (Aug. 2015).
Tang, H., et al., "Epitopes immediately below the base of the V3 loop of gp120 as targets for the initial autologous neutralizing antibody response in two HIV-I subtype B-infected individuals," Journal of Virology, vol. 85, No. 18, pp. 9286-9299 (Sep. 2011).
Tomaras, G. D., et al., "Initial B-cell Responses to Transmitted Human Immunodeficiency Virus Type 1: Virion-Binding Immunoglobulin M (IgM) and IgG Antibodies Followed by Plasma Anti-gp41 Antibodies with Ineffective Control of Initial Viremia," Journal of Virology, vol. 82, No. 24, pp. 12449-12463 (Dec. 2008).
Tsukiji, S., et al., "Sortase-Mediated Ligation: A Gift from Gram-Positive Bacteria to Protein Engineering," ChemBioChem, vol. 10, pp. 787-798, DOI: 10.1002/cbic.200800724 (2009).
Verkoczy, L., et al., "Autoreactivity in an HIV-1 broadly reactive neutralizing antibody variable region heavy chain induces immunologic tolerance," Proceedings of the National Academy of Sciences of the United States of America, vol. 107, No. 1, pp. 181-186 (Jan. 2010).

(56) References Cited

OTHER PUBLICATIONS

Verkoczy, L., et al., "Rescue of HIV-1 Broad Neutralizing Antibody-Expressing B Cells in 2F5 $V_H$x$V_L$ Knockin Mice Reveals Multiple Tolerance Controls," Journal of Immunology, vol. 187(7), pp. 3785-3797, 28 total pages (Oct. 1, 2011).

Walker, L. M., et al., "Broad neutralization coverage of HIV by multiple highly potent antibodies," Nature, vol. 477, No. 7365, pp. 466-470, Author Manuscript—14 total pages (Sep. 22, 2011).

Walker, L. M., et al., "Broad and potent neutralizing antibodies from an African donor reveal a new HIV-1 vaccine target," Science, vol. 326, pp. 285-289 (Oct. 9, 2009).

West, A. P., et al., "Structural basis forgerm-line gene usage of a potent class of antibodies targeting the CD4-binding site of HIV-I gp120," Proceedings of the National Academy of Sciences of the United States of America, E2083-E2090, www.pnas.org/cgi/doi/10.1073/pnas.1208984109 (Jun. 27, 2012).

Williams, L. D., et al., "Potent and broad HIV-neutralizing antibodies in memory B cells and plasma," Science Immunology, vol. 2, eaal2200, pp. 1-15 (Jan. 27, 2017).

Wu, X., et al., "Focused evolution of HIV-1 neutralizing antibodies revealed by structures and deep sequencing," Science, vol. 333, No. 6049, pp. 1593-1602, Author Manuscript—17 total pages (Sep. 16, 2011).

Wu, X., et al., "Maturation and Diversity of the VRC01-Antibody Lineage over 15 Years of Chronic HIV-1 Infection," Cell, vol. 161, No. 3, pp. 470-485, Author Manuscript—31 total pages (Apr. 23, 2015).

Wu, X., et al., "Rational design of envelope identifies broadly neutralizing human monoclonal antibodies to HIV-1," Science, vol. 329, No. 5993, pp. 856-861, Author Manuscript—12 total pages (Aug. 13, 2010).

Xiao, X., et al., "Germline-like predecessors of broadly neutralizing antibodies lack measurable binding to HIV-I envelope glycoproteins: implications for evasion of immune responses and design of vaccine immunogens," Biochemical and Biophysical Research Communications, vol. 390, pp. 404-409 (2009).

Yacoob, C., et al., "Differences in Allelic Frequency and CDRH3 Region Limit the Engagement of HIV Env Immunogens by Putative VRC0I Neutralizing Antibody Precursors," Cell Reports, vol. 17, No. 6, pp. 1560-1570, Author Manuscript—24 total pages (Nov. 1, 2016).

Yang, X., et al., "Antibody binding is a dominant determinant of the efficiency of human immunodeficiency virus type 1 neutralization," Journal of Virology, vol. 80, No. 22, pp. 11404-11408 (Nov. 2006).

Yu, Jae-Sung, et al., "Recombinant Mycobacterium bovis Bacillus Calmette-Guerin Elicits Human Immunodeficiency Virus Type 1 Envelope-Specific T Lymphocytes at Mucosal Sites," Clinical and Vaccine Immunology, vol. 14, No. 7, pp. 886-893 (Jul. 2007).

Zhang, J., et al., "Optimality of Mutation and Selection in Germinal Centers," Public Library of Science Computational Biology, vol. 6, No. 6, pp. 1-9 (Jun. 2010).

Zhou, T., et al., "Multi-donor analysis reveals structural elements, genetic determinants, and maturation pathway for HIV-1 neutralization by VRCO1-class antibodies," Immunity, vol. 39, No. 2, pp. 245-258, Author Manuscript—26 total pages (Aug. 22, 2013).

Zhou, T., et al., "Quantification of the Impact of the HIV-1-Glycan Shield on Antibody Elicitation," Cell reports, vol. 19, pp. 719-732 (Apr. 25, 2017).

Zhou, T., et al., "Structural basis for broad and potent neutralization of HIV-1 by antibody VRC01," Science, vol. 329, No. 5993, pp. 811-817, Author Manuscript—19 total pages (Aug. 13, 2010).

Zhou, T., et al., "Structural definition of a conserved neutralization epitope on HIV-1 gp120," Nature, vol. 445, No. 7129, pp. 732-737, Author Manuscript—15 total pages (Feb. 15, 2007).

Zhou, T., et al., "Structural Repertoire of HIV-1-Neutralizing Antibodies Targeting the CD4 Supersite in 14 Donors," Cell, vol. 161, No. 6, pp. 1280-1292, Author Manuscript—26 total pages (Jun. 4, 2015).

Zhu, X., et al., "Mass spectrometric characterization of the glycosylation pattern of HIV-gp120 expressed in CHO cells," Biochemistry, vol. 39, pp. 11194-11204 (2000).

Zwick, M. B., et al., "Broadly neutralizing antibodies targeted to the membrane-proximal external region of human immunodeficiency virus type I glycoprotein gp41," Journal of Virology, vol. 75, No. 22, pp. 10892-10905 (Nov. 2001).

De Taeye, S. W., et al., "HIV-1 envelope trimer design and immunization strategies to induce broadly neutralizing antibodies," Trends Immunol., vol. 37, No. 3, pp. 221-232 (Mar. 2016)—Author Manuscript available in PMC Jun. 2, 2017 (19 total pages).

GenBank Accession Nos. KC576304-KC576477, last downloaded from https://www.ncbi.nlm.nih.gov/nucore on May 14, 2020 (33 total pages).

Go, E.P., et al., "Characterization of Glycosylation Profiles of HIV-1 Transmitted/Founder Envelopes by Mass Spectrometry," Journal of Virology, vol. 85, No. 16, pp. 8270-8284 (Aug. 2011).

McClure, M. O., et al. "HIV infection of primate lymphocytes and conservation of the CD4 receptor," Nature, vol. 330, pp. 487-489 (Dec. 3, 1987).

Calarese, D.A, et al., "Antibody domain exchange is an immunological solution to carbohydrate cluster recognition," Science, vol. 300, pp. 2065-2071 (Jun. 27, 2003).

Lynch, R. M., et al., "Virologic effects of broadly neutralizing antibody VRC01 administration during chronic HIV-1 infection," Science Translational Medicine, vol. 7, Issue 319, pp. 1-14 (Dec. 23, 2015).

Mascola, J.R., et al., "The role of antibodies in HIV vaccines," Annual Reviews of Immunology, vol. 28, pp. 413-444. doi: 10.1146/annurev-immunol-030409-101256 (2010).

Wimley, W. C., et al., "Solvation energies of amino acid side chains and backbone in a family of host-guest pentapeptides," Biochemistry, vol. 35, No. 16, pp. 5109-5124 (1996).

| Plasmid ID | Env name | Vector | 3' Bar code |
|---|---|---|---|
| HV1300656 | CH505.M5gp145 | VRC8400 | TGATGAGgtgaccgaattcgggacccggatcc |
| HV1300662 | CH505.M11gp145 | VRC8400 | TGATGAGgtgaccgaattcaggtcccggatcc |
| HV1300635 | CH505w020.14gp145 | VRC8400 | TGATGAGggacccgaattcggtcaccggatcc |
| HV1300636 | CH505w030.28gp145 | VRC8400 | TGATGAGggtcctgaattcggttaccggatcc |
| HV1300639 | CH505w078.15gp145 | VRC8400 | TGATGAGaattcggtcacggggtcctggatcc |
| HV1300638 | CH505w053.31gp145 | VRC8400 | TGATGAGaattcggtgaccgggacctggatcc |

CH505 Env gp145 and gp120 gene constructs were cloned into VRC8400 at the unique SalI and BamHI sites.

Figure 1

| Name | SEQ ID NO |
|---|---|
| >HV1300656, CH505.M5gp145 | 25 |
| >HV1300662, CH505.M1gp145 | 26 |
| >HV1300635, CH505w020.14gp145 | 27 |
| >HV1300636, CH505w030.28gp145 | 28 |
| >HV1300639, CH505w078.15gp145 | 29 |
| >HV1300638, CH505w053.31gp145 | 30 |
| >HV1300656, CH505.M5gp145 | 31 |
| >HV1300662, CH505.M11gp145 | 32 |
| >HV1300635, CH505w020.14gp145 | 33 |
| >HV1300636, CH505w030.28gp145 | 34 |
| >HV1300638, CH505w053.31gp145 | 35 |
| >HV1300639, CH505w078.15gp145 | 36 |
| >HV1300638, CH505w053.31gp145 | 37 |

Figure 1 cont.

| Env name | Plasmid ID | Bar code |
|---|---|---|
| CH505.M5D8gp120 | HV1300531_v2 | TAGTAAGgtgaccgaattcgggacccggatcc |
| CH505.M11D8gp120 | HV1300537_v2 | TAGTAAGgtgaccgaattcaggtcccggatcc |
| CH505w020.14D8gp120 | HV1300556_v2 | TAGTAAGggacccgaattcggtcaccggatcc |
| CH505w030.28D8gp120 | HV1300578_v2 | TAGTAAGggtcctgaattcggttaccggatcc |
| CH505w078.15D8gp120 | HV1300592 | TAGTAAGaattcggtcaccgggtcctggatcc |
| CH505w053.31D8gp120 | HV1300596 | TAGTAAGaattcggtgaccgggacctggatcc |

Figure 1 cont.

| Name | SEQ ID NO |
|---|---|
| >HV1300531_v2, CH505.M5D8gp120 | 44 |
| >HV1300537_v2, CH505.M11D8gp120 | 45 |
| >HV1300556_v2, CH505w020.14D8gp120 | 46 |
| >HV1300578_v2, CH505w030.28D8gp120 | 47 |
| >HV1300592, CH505w078.15D8gp120 | 48 |
| >HV1300586, CH505w053.31D8gp120 | 49 |
| >HV1300531_v2, CH505.M5D8gp120 | 50 |
| >HV1300537_v2, CH505.M11D8gp120 | 51 |
| >HV1300556_v2, CH505w020.14D8gp120 | 52 |
| >HV1300578_v2, CH505w030.28D8gp120 | 53 |
| >HV1300592, CH505w078.15D8gp120 | 54 |
| >HV1300586, CH505w053.31D8gp120 | 55 |
| >CH505.M5gp160 | 56 |
| >CH505.M11gp160 | 57 |
| >CH505w020.14gp160 | 58 |
| >CH505w030.28gp160 | 59 |
| >CH505w078.15gp160 | 60 |
| >CH505w053.31gp160 | 61 |
| >CH505.M5gp160 | 62 |
| >CH505.M11gp160 | 63 |
| >CH505w020.14gp160 | 64 |
| >CH505w030.28gp160 | 65 |
| >CH505w078.15gp160 | 66 |
| >CH505w053.31gp160 | 67 |

Figure 1 cont.

| Env name | Plasmid ID | Bar code |
|---|---|---|
| CH505.M5gp145 | HV1300656 | TGATGAGgtgaccgaattcgggacccggatcc |
| CH505.M11gp145 | HV1300662 | TGATGAGgtgaccgaattcaggtcccggatcc |
| CH505w020.14gp145 | HV1300635 | TGATGAGggacccgaattcggtcaccggatcc |
| CH505w030.28gp145 | HV1300636 | TGATGAGggtcctgaattcggttaccggatcc |
| CH505w078.15gp145 | HV1300639 | TGATGAGaattcggtcaccgggtcctggatcc |
| CH505w53.16gp145 | HV1300696 | TGATGAGaattcggtgaccgggtcccggatcc |
| CH505w30.21gp145 | HV1300689 | TGATGAGggtcccgaattcggttaccggatcc |
| CH505w78.33gp145 | HV1300705 | TGATGAGaattcggtaaccaggtcccggatcc |
| CH505w100.B6gp145 | HV1300714 | TGATGAGgtaaccgggacccgaattcggatcc |
| CH505w053.31gp145 | HV1300638 | TGATGAGaattcggtgaccgggacctggatcc |

CH505 Env gp145 gene constructs were cloned into VRC8400 at the unique SalI and BamHI sites.

Figure 2A

| Name | SEQ ID NO |
|---|---|
| >HV1300656, CH505.M5gp145 | 78 |
| >HV1300662, CH505.M11gp145 | 79 |
| >HV1300635, CH505w020.14gp145 | 80 |
| >HV1300636, CH505w030.28gp145 | 81 |
| >HV1300639, CH505w078.15gp145 | 82 |
| >HV1300696, CH505w53.16gp145 | 83 |
| >HV1300689, CH505w30.21gp145 | 84 |
| >HV1300705, CH505w78.33gp145 | 85 |
| >HV1300714, CH505w100.B6gp145 | 86 |
| >HV1300638, CH505w053.31gp145 | 87 |
| >HV1300656, CH505.M5gp145 | 88 |
| >HV1300662, CH505.M11gp145 | 89 |
| >HV1300635, CH505w020.14gp145 | 90 |
| >HV1300636, CH505w030.28gp145 | 91 |
| >HV1300638, CH505w053.31gp145 | 92 |
| >HV1300696, CH505w53.16gp145 | 93 |
| >HV1300689, CH505w30.21gp145 | 94 |
| >HV1300705, CH505w78.33gp145 | 95 |
| >HV1300714, CH505w100.B6gp145 | 96 |
| >HV1300639, CH505w078.15gp145 | 97 |
| >HV1300638, CH505w053.31gp145 | 98 |

Figure 2A cont.

| Env name | Plasmid ID | Bar code |
|---|---|---|
| CH505.M5D8gp120 | HV1300531_v2 | TAGTAAGgtgaccgaattcgggacccggatcc |
| CH505.M11D8gp120 | HV1300537_v2 | TAGTAAGgtgaccgaattcaggtcccggatcc |
| CH505w020.14D8gp120 | HV1300556_v2 | TAGTAAGggacccgaattcggtcaccggatcc |
| CH505w030.28D8gp120 | HV1300578_v2 | TAGTAAGggtcctgaattcggttaccggatcc |
| CH505w078.15D8gp120 | HV1300592 | TAGTAAGaattcggtcaccgggtcctggatcc |
| CH505w053.16D8gp120 | HV1300583 | TAGTAAGaattcggtgaccgggtcccggatcc |

CH505 Env gp120 gene constructs were cloned into VRC8400 at the unique SalI and BamHI sites.

Figure 2B

| Name | SEQ ID NO |
|---|---|
| >HV1300531_v2, CH505.M5D8gp120 | 105 |
| >HV1300537_v2, CH505.M11D8gp120 | 106 |
| >HV1300556_v2, CH505w020.14D8gp120 | 107 |
| >HV1300578_v2, CH505w030.28D8gp120 | 108 |
| >HV1300592, CH505w078.15D8gp120 | 109 |
| >HV1300583, CH505w053.16D8gp120 | 110 |
| >HV1300574_v2, CH505w030.21D8gp120 | 111 |
| >HV1300595, CH505w078.33D8gp120 | 112 |
| >HV1300605, CH505w100.B6D8gp120 | 113 |
| >HV1300586, CH505w053.31D8gp120 | 114 |
| >HV1300531_v2, CH505.M5D8gp120 | 115 |
| >HV1300537_v2, CH505.M11D8gp120 | 116 |
| >HV1300556_v2, CH505w020.14D8gp120 | 117 |
| >HV1300578_v2, CH505w030.28D8gp120 | 118 |
| >HV1300592, CH505w078.15D8gp120 | 119 |
| >HV1300583, CH505w053.16D8gp120 | 120 |
| >HV1300574_v2, CH505w030.21D8gp120 | 121 |
| >HV1300595, CH505w078.33D8gp120 | 122 |
| >HV1300605, CH505w100.B6D8gp120 | 123 |
| >HV1300586, CH505w053.31D8gp120 | 124 |

Figure 2B cont.

gp160 constructs:

| Name | SEQ ID NO |
|---|---|
| >CH505.M5gp160 | 125 |
| >CH505.M11gp160 | 126 |
| >CH505w020.14gp160 | 127 |
| >CH505w030.28gp160 | 128 |
| >CH505w078.15gp160 | 129 |
| >CH505w053.16gp160 | 130 |
| >CH505w030.21gp160 | 131 |
| >CH505w078.33gp160 | 132 |
| >CH505w100.B6gp160 | 133 |
| >CH505w053.31gp160 | 134 |
| >CH505.M5gp160 | 135 |
| >CH505.M11gp160 | 136 |
| >CH505w020.14gp160 | 137 |
| >CH505w030.28gp160 | 138 |
| >CH505w078.15gp160 | 139 |
| >CH505w053.16gp160 | 140 |
| >CH505w030.21gp160 | 141 |
| >CH505w078.33gp160 | 142 |
| >CH505w100.B6gp160 | 143 |
| >CH505w053.31gp160 | 144 |

| Virus | Mutation | UCA | IA8 | IA7 | IA6 | IA5 | IA4 | IA3 | IA2 | IA1 | CH103 | CH104 | CH105 | CH106 |
|---|---|---|---|---|---|---|---|---|---|---|---|---|---|---|
| T/F | None | >50 | 44.67 | 10.17 | 10.17 | 8.82 | 8.72 | 8.82 | 2.73 | 1.42 | 4.14 | 3.08 | 0.10 | 2.09 |
| M6 | N279K | >50 | >50 | 21.33 | 4.46 | 10.57 | 10.08 | 8.09 | 1.43 | 0.41 | 1.27 | 1.30 | 0.00 | 1.00 |
| M10 | V281A | >50 | 13.61 | 2.51 | 4.32 | 2.99 | 3.36 | 3.08 | 1.57 | 0.91 | 0.54 | 0.61 | 1.30 | 0.68 |
| M18 | V281G | >50 | >50 | 10.98 | 8.47 | 4.90 | 8.23 | 1.90 | 0.68 | 0.39 | 0.66 | 0.64 | 1.21 | 0.84 |
| M9 | V281D | >50 | 8.96 | 2.84 | 2.85 | 0.34 | 2.83 | 1.97 | 0.37 | 0.28 | 0.51 | 0.22 | 0.88 | 0.12 |
| M51 | N280S + V281A | >50 | 16.34 | 27.81 | 8.73 | 8.48 | 10.83 | 3.06 | 0.81 | 0.41 | 0.53 | 0.64 | 1.25 | 0.80 |
| M29 | N279D + V281G | >50 | >50 | 6.10 | 2.02 | 1.48 | 2.76 | 1.48 | 0.84 | 0.20 | 0.46 | 0.40 | 0.99 | 0.96 |
| M61 | N280T + V281G | >50 | >50 | 13.44 | 8.12 | 3.05 | 4.21 | 1.31 | 0.60 | 0.33 | 0.34 | 0.38 | 1.13 | 0.88 |
| M7 | E279K + N279D + V281S | >50 | 6.63 | 2.58 | 2.99 | 2.06 | 8.12 | 1.47 | 0.37 | 0.36 | 0.38 | 0.37 | 0.65 | 0.13 |

| Virus | Mutation | UCA | IA4 | IA3 | IA2 | IA1 | CH235 | CH236 | CH239 | CH240 | CH241 |
|---|---|---|---|---|---|---|---|---|---|---|---|
| T/F | None | >50 | >50 | 5.22 | 0.97 | 0.91 | 0.63 | 0.61 | 0.48 | 0.94 | 0.14 |
| M5 | N279K | >50 | 27.69 | 1.21 | 0.69 | 0.20 | 0.18 | 0.26 | 0.06 | 0.22 | <0.023 |
| M6 | V281A | >50 | >50 | 21.93 | >50 | 0.98 | 0.41 | 0.80 | 0.26 | 1

| Time point | Virus | UCA | IA4 | IA3 | IA2 | IA1 | CH235 | CH236 | CH239 | CH240 | CH241 | CD4bs bnAb CH91 |
|---|---|---|---|---|---|---|---|---|---|---|---|---|
| | T/F | >50 | >50 | 5.22 | 0.97 | 0.91 | 0.63 | 0.81 | 0.48 | 0.94 | 0.14 | <0.023 |
| Week 4 | w4.3 | >50 | >50 | 1.65 | 0.35 | 0.30 | 0.11 | 0.40 | 0.10 | 0.25 | <0.023 | <0.023 |
| | w4.26 | >50 | >50 | 3.67 | 1.36 | 0.32 | 0.46 | 0.78 | 0.30 | 0.67 | 0.05 | <0.023 |
| | w4.10 | >50 | 20.51 | 1.02 | 0.24 | 0.20 | 0.10 | 0.10 | <0.023 | 0.15 | <0.023 | >50 |
| Week 14 | w14.21 | >50 | >50 | >50 | 38.08 | 0.79 | 0.38 | 0.96 | 0.14 | 0.58 | 0.04 | 0.13 |
| | w14.3 | >50 | >50 | 6.28 | 1.40 | 0.79 | 0.49 | 0.75 | 0.40 | 1.05 | 0.09 | <0.023 |
| | w14.4 | >50 | >50 | 3.60 | 1.00 | 0.72 | 0.27 | 0.88 | 0.40 | 0.60 | 0.08 | <0.023 |
| | w14.6 | >50 | >50 | 5.73 | 1.64 | 0.92 | 0.31 | 0.63 | 0.43 | 0.73 | 0.17 | <0.023 |
| | w14.29 | >50 | >50 | 5.34 | 1.02 | 0.86 | 0.75 | 1.05 | 0.61 | 0.88 | 0.17 | <0.023 |
| | w14.34 | >50 | >50 | 4.84 | 0.94 | 0.84 | 0.52 | 1.09 | 0.78 | 0.89 | 0.12 | 0.02 |
| | w14.12 | >50 | >50 | 34.99 | 2.22 | 0.85 | 0.42 | 0.53 | 0.41 | 0.93 | 0.09 | <0.023 |
| Week 20 | w20.14 | >50 | >50 | 10.80 | 1.99 | 0.91 | 0.63 | 0.81 | 0.48 | 0.96 | 0.09 | <0.023 |
| | w20.7 | >50 | >50 | >50 | 31.29 | 0.85 | 0.43 | 1.30 | 0.28 | 0.85 | 0.06 | 0.14 |
| | w20.27 | >50 | >50 | 10.28 | 2.06 | 0.98 | 0.39 | 0.46 | 0.27 | 1.13 | 0.10 | <0.023 |
| | w20.4 | >50 | >50 | >50 | 47.61 | 0.84 | 0.65 | 1.81 | 0.18 | 1.00 | 0.06 | 0.12 |
| | w20.19 | >50 | >50 | 8.99 | 2.12 | 1.99 | 1.16 | 1.24 | 1.11 | 1.63 | 0.27 | 0.02 |
| | w20.25 | >50 | >50 | 8.54 | 1.69 | 1.85 | 1.08 | 0.85 | 0.75 | 1.41 | 0.18 | <0.023 |
| Week 30 | w30.28 | >50 | >50 | >50 | >50 | 5.28 | 2.16 | 9.14 | 2.07 | 5.28 | 0.40 | >50 |
| | w30.13 | >50 | >50 | >50 | 27.95 | 4.73 | 1.15 | 4.39 | 1.49 | 5.11 | 2.96 | >50 |
| | w30.24 | >50 | >50 | 29.77 | 2.08 | 4.62 | 2.06 | 3.69 | 1.54 | 4.12 | 0.49 | 0.35 |
| | w30.5 | >50 | >50 | >50 | 7.72 | 1.83 | 0.80 | 0.58 | 0.67 | 2.08 | 1.17 | 0.04 |
| | w30.34 | >50 | >50 | >50 | 4.98 | 5.18 | 3.23 | 2.27 | 3.02 | 5.61 | 3.68 | 0.15 |
| | w30.37 | >50 | >50 | >50 | 6.45 | 6.92 | 4.25 | 2.60 | 2.79 | 7.57 | 3.99 | 0.17 |

Figure 13

| | | | | | | | | | | |
|---|---|---|---|---|---|---|---|---|---|---|
| Week 53 | w53.31 | >50 | >50 | >50 | >50 | >50 | >50 | >50 | >50 | >50 |
| | w53.13 | >50 | >50 | >50 | >50 | >50 | >50 | >50 | >50 | 11.58 |
| | w53.28 | >50 | >50 | >50 | >50 | >50 | >50 | >50 | >50 | 12.04 |
| | w53.22 | >50 | >50 | >50 | >50 | >50 | 33.78 | >50 | >50 | 34.28 |
| | w53.6 | >50 | >50 | >50 | >50 | >50 | >50 | >50 | >50 | 0.93 |
| | w53.11 | >50 | >50 | >50 | >50 | >50 | 19.95 | >50 | >50 | 21.96 |
| Week 78 | w78.15 | >50 | >50 | >50 | >50 | 46.43 | >50 | >50 | >50 | 22.63 |
| | w78.1 | >50 | >50 | >50 | >50 | >50 | >50 | >50 | >50 | >50 |
| | w78.33 | >50 | >50 | >50 | >50 | >50 | >50 | >50 | 33.95 | 32.10 |
| | w78.6 | >50 | >50 | >50 | >50 | >50 | >50 | >50 | >50 | >50 |
| | w78.9 | >50 | >50 | >50 | >50 | >50 | >50 | >50 | >50 | 35.39 |
| | w78.5 | >50 | >50 | >50 | >50 | >50 | >50 | >50 | >50 | 20.20 |
| Week 100 | w100.B4 | >50 | >50 | >50 | >50 | >50 | >50 | >50 | >50 | 49.40 |
| | w100.A3 | >50 | >50 | >50 | >50 | >50 | >50 | >50 | 45.37 | 45.85 |
| | w100.A5 | >50 | >50 | >50 | >50 | >50 | >50 | >50 | >50 | 46.55 |
| | w100.B6 | >50 | >50 | >50 | >50 | >50 | >50 | >50 | >50 | >50 |
| | w100.A10 | >50 | >50 | >50 | >50 | >50 | 48.62 | >50 | 41.17 | >50 |
| | w100.B8 | >50 | >50 | >50 | >50 | >50 | >50 | >50 | >50 | >50 |

Values are the concentrations (μg/ml) of antibodies required for the 50% inhibition ($IC_{50}$).

Figure 13 cont.

CH235 Lineage

| | UCA | IA4 | IA3 | IA2 | IA1 | CH240 | CH236 | CH235 | CH239 | CH241 | CH491 | CH493 | CH558 | CH557 |
|---|---|---|---|---|---|---|---|---|---|---|---|---|---|---|
| CH505.M5 gp120 | 0.2 | 1.4 | 7 | 6.9 | 9.2 | 7.4 | 7.3 | 11 | 13 | 15 | 11 | 9.3 | 6.5 | 8.2 |
| CH505.M11 gp120 | nb | nb | nb | nb | 2.8 | 0.5 | 1.4 | 7.6 | 1.4 | 9.7 | 6.8 | 8.3 | 5.4 | 7.7 |
| CH505w20.14 gp120 | nb | nb | 2.7 | 1.2 | 6.5 | 3.8 | 8.7 | 9.9 | 9 | 13 | 9.3 | 8.2 | 8.1 | 8.3 |
| CH505w30.20 gp120 | nb | 0.2 | 1.2 | 0.5 | 4.8 | 1.5 | 6.2 | 8.3 | 8 | 8 | 8.8 | 8.1 | 5.4 | 8.6 |
| CH505w30.12 gp120 | nb | nb | nb | nb | 2.4 | 0.4 | 1 | 7.3 | 3.4 | 9.6 | 3.9 | 3.2 | 1 | 2.4 |
| CH505w136.B18 gp120 | nb | nb | nb | nb | 2.4 | 0.3 | 3.5 | 7.5 | 0.7 | 0.9 | 3.5 | 5.8 | 1.8 | 8.3 |

Figure 16A

CH103 Lineage

| UCA | IA8 | IA7 | IA6 | IA4 | CH186 | CH187 | CH188 | CH200 | 1AH92U | IA3 | CH105 | IA2 | CH104 | IA1 | CH106 | CH103 | CH243 | CH244 | CH245 | CH247 | CH248 |
|---|---|---|---|---|---|---|---|---|---|---|---|---|---|---|---|---|---|---|---|---|---|
| nb | 0.6 | 2.3 | 3.3 | 3.8 | 12 | 9.4 | 9 | 8.9 | 6.1 | 6.9 | 8.6 | 7.8 | 9 | 7 | 8.4 | 9.8 | 10 | 10 | 11 | 11 | 11 |
| 2.6 | 6.2 | 10 | 10 | 10 | 14 | 13 | 13 | 11 | 12 | 12 | 12 | 13 | 12 | 12 | 13 | 13 | 14 | 14 | 14 | 14 | 14 |
| 0.3 | 3.4 | 7.2 | 7.9 | 8.6 | 13 | 11 | 11 | 8.7 | 10 | 11 | 10 | 11 | 10 | 10 | 11 | 13 | 13 | 12 | 12 | 12 | 12 |
| nb | nb | nb | nb | nb | 8.6 | 1.2 | 1.2 | 2.8 | 4.9 | 4.6 | 7.1 | 6.3 | 7.5 | 5.7 | 7.3 | 9.6 | 9 | 10 | 9.9 | 12 | 10 |
| nb | 0.4 | 1 | 1.2 | 1.9 | 12 | 12 | 12 | 7.3 | 9.4 | 7.6 | 11 | 12 | 12 | 11 | 12 | 13 | 14 | 14 | 14 | 14 | 13 |
| nb | nb | nb | nb | nb | nb | nb | nb | nb | 8.7 | 14 | 14 | 14 | 14 | 14 | 13 | 12 | 14 | 15 | 15 | 13 | 14 |

Figure 16B

| gp120 | Plasmid ID |
|---|---|
| CH505.M5D8gp120 | HV1300531_v2 |
| CH505.M11D8gp120 | HV1300537_v2 |
| CH505w020.14D8gp120 | HV1300556_v2 |
| CH505w030.20D8gp120 | HV1300573_v2 |
| CH505.w30.12D8gp120 | HV1300778 |
| CH505w136.B8D8gp120 | HV1300612 |

Coding sequence is in capital letters

| Name | SEQ ID NO |
|---|---|
| >HV1300531_v2, CH505.M5D8gp120 | 145 |
| >HV1300537_v2, CH505.M11D8gp120 | 146 |
| >HV1300556_v2, CH505w020.14D8gp120 | 147 |
| >HV1300573_v2, CH505w030.20D8gp120 | 148 |
| >HV1300778, CH505.w30.12D8gp120 | 149 |
| >HV1300612, CH505w136.B8D8gp120 | 150 |
| >HV1300531_v2, CH505.M5D8gp120 | 151 |
| >HV1300537_v2, CH505.M11D8gp120 | 152 |
| >HV1300556_v2, CH505w020.14D8gp120 | 153 |
| >HV1300573_v2, CH505w030.20D8gp120 | 154 |
| >HV1300778, CH505.w30.12D8gp120 | 155 |
| >HV1300612, CH505w136.B8D8gp120 | 156 |

Figure 17A

| Name | SEQ ID NO |
|---|---|
| >CH505.M5 gp160 | 157 |
| >CH505.M11 gp160 | 158 |
| >CH505w020.14 gp160 | 159 |
| >CH505w030.20 gp160 | 160 |
| >CH505.w30.12gp160 | 161 |
| >CH505w136.B8 gp160 | 162 |
| >CH505.M5gp160 | 163 |
| >CH505.M11 gp160 | 164 |
| >CH505w020.14 gp160 | 165 |
| >CH505w030.20 gp160 | 166 |
| >CH505w30.12 gp160 | 167 |
| >CH505w136.B8 | 168 |

Figure 17B

| gp120 | Plasmid ID | gp145 | Plasmid ID |
|---|---|---|---|
| CH505.M5D8gp120 | HV1300531_v2 | CH505.M5gp145 | HV1300656 |
| CH505.M11D8gp120 | HV1300537_v2 | CH505.M11gp145 | HV1300662 |
| CH505w020.14D8gp120 | HV1300556_v2 | CH505w020.14gp145 | HV1300635 |
| CH505w030.20D8gp120 | HV1300573_v2 | CH505w30.20gp145 | HV1300688 |
| CH505.w30.12D8gp120 | HV1300778 | CH505.w30.12gp145 | HV1300646 |
| CH505w136.B18D8gp120 | HV1300615 | CH505w136.B18gp145 | HV1300724 |

Figure 19A

| Name | SEQ ID NO |
|---|---|
| >HV1300531_v2, CH505.M5D8gp120 | 169 |
| >HV1300537_v2, CH505.M11D8gp120 | 170 |
| >HV1300556_v2, CH505w020.14D8gp120 | 171 |
| >HV1300573_v2, CH505w030.20D8gp120 | 172 |
| >HV1300778, CH505.w30.12D8gp120 | 173 |
| >HV1300615, CH505w136.B18D8gp120 | 174 |
| >HV1300531_v2, CH505.M5D8gp120 | 175 |
| >HV1300537_v2, CH505.M11D8gp120 | 176 |
| >HV1300556_v2, CH505w020.14D8gp120 | 177 |
| >HV1300573_v2, CH505w030.20D8gp120 | 178 |
| >HV1300778, CH505.w30.12D8gp120 | 179 |
| >HV1300615, CH505w136.B18D8gp120 | 180 |
| >HV1300656, CH505.M5gp145 | 181 |
| >HV1300662, CH505.M11gp145 | 182 |
| >HV1300635, CH505w020.14gp145 | 183 |
| >HV1300688, CH505w30.20gp145 | 184 |
| >HV1300646, CH505.w30.12gp145 | 185 |
| >HV1300724, CH505w136.B18gp145 | 186 |
| >HV1300656, CH505.M5gp145, | 187 |
| >HV1300662, CH505.M11gp145, | 188 |
| >HV1300635, CH505w020.14gp145, | 189 |
| >HV1300688, CH505w30.20gp145, | 190 |
| >HV1300646, CH505.w30.12gp145, | 191 |
| >CH505w136.B18gp145, HV1300724, | 192 |

>CH505.w136.818 gp160 plasmid

GTCGTCGACAAGAAGCCACCATGCGCGTGATGGGCCGGCAGCGCAACTACCCGCAGTGGTGGATCTGGTCGATGCT
GGGCCTCTGGATGCTCATGATCTGCAACGGCATGTGGGTGACGGTGTACTACGGCGTGCCGGTGTGGAAGGAGGCC
AAGACGACCCTGTTCTGCGCGTCGGACGCCAAGGCCTACGAGAAGGAGGTGCACAACGTGTGGGCGACCCACGCCT
GCGTGCCCACGGACCCCAACCCGCAGGAGATGGTGCTGAAGAACGTGACCGAGAACTTCAACATGTGGAAGAACGA
CATGGTGGACCAGATGCACGAGGACGTGATCTCCCTGTGGGACCAGTCCCTGACGCCCTGCGTGAAGCTGACCCCGC
TGTGCGTGACCCTGAACTGCACGGACGCCAACGACACCGCGTCGAACAGCTCCATCATCAAGGGGATGAACAACTCC
ATCGTGGGGGAGATGAAGAACTGCTCCTTCAACATCACGACGGAGCTGCGCGACAAGCGCGAGAAGAAGAACGCCC
TGTTCTACAAGCTGGACATCGTGCAGCTGGACGGCAACTCCTCGGAGTACAGGCTGATCAACTGCAACACCTCCGTCA
TCACGCAGGCGTGCCCCAAGGTGTCCTTCGACCCCATCCCCATCCACTACTGCGCCCCCGCCGGCTACGCCATCCTGA
AGTGCAACAACAAGACCTTCAACGGCACCGGCCCGTGCAACAACGTGTCCACCGTGCAGTGCACGCACGGGATCAAG
CCCGTGGTGTCCACGCAGCTGCTCCTGAACGGGTCGCTGGCCGAGGGCGAGATCATCATCCGGTCGGAGAACATCAC
GGACAACGCGAAGACCATCATCGTGCACCTGAACGAGTCCGTGAAGATCGAGTGCACCCGCCCGAGCAACAACACG
CGCACCTCCATCCGGATCGGCCCTGGCCAGGCCTTCTACGCCACCGGCCAGGTGATCGGCGACATCCGCAAGGCGCA
CTGCAACATCTCCGAGTCCAAGTGGAACGAGACCCTGCAGCGCGTGTCCAAGAAGCTGAAGGAGTACTTCCCCGACA
AGAACATCACCTTCCAGCCGTCGTCCGGCGGCGACCCCGAGATCACCACGCACTCCTTCAACTGCGGTGGCGAGTTCT
TCTACTGCAACACGTCGTCCCTGTTCAACCGCACCTACATGGCCAACTCGACGGACATGGCGAACTCCGCGGAGACCA
ACTCCACGCGCACCATCACGCTCCACTGCCGCATCAAGCAGATCATCAACATGTGGCAGGAGGTGGGCCGCGCCATG
TACGCACCGCCCATCGCCGGCAACATCACCTGCATCTCCAACATCACCGGCCTCCTGCTGACCCGCGACGGAGGCAAC
TCCAGCACGGAGACGGAGACCTTCAGGCCAGGGGGAGGCAACATGAAGGACAACTGGCGCTCCGAGCTGTACAAGT
ACAAGGTGGTGGAGGTGAAGCCCCTGGGCGTGGCACCCACCAACGCCCGCAGGCGCGTGGTGGAGCGCGAGAAGC
GCGCCGTGGGCATGGGCGCCGTGTTCCTGGGCTTCCTGGGCGCTGCGGGCTCCACCATGGGTGCCGCGTCCATCACC
CTGACCGTGCAGGCCCGCCAGCTGCTCTCCGGCATCGTGCAGCAGCAGTCCAACCTCCTGAAGGCCATCGAGGCCCA
GCAGCACATGCTGCGGCTGACCGTGTGGGGCATCAAGCAGCTGCAGGCCAGGGTGCTCGCGCTCGAGCGCTACCTG
AAGGACCAGCAGCTGCTCGGCATGTGGGGCTGCTCCGGCAAGCTGATCTGCACCACCAACGTGTACTGGAACTCGTC
CTGGTCCAACAAGACCTACGACGACATCTGGGACAACATGACCTGGATGCAGTGGGAGGGGGAGATCTCCAACTAC
ACCAACATCATCTACGACCTCCTCGAGGAGTCCCAGAACCAGCAGGAGAAGAACGAGCAGGATCTGCTCGCGCTGGA
CCGCTGGAACTCCCTGTGGAACTGGTTCAACATCACCAACTGGCTGTGGTACATCAAGATCTTCATCATGATCGTGGG
CGGCCTGATCGGCCTGCGGATCATCTTCGCCGTGCTGTCGCTGGTGAACCGCGTGCGCCAGGGCTACTCCCCGCTGTC
CCTGCAAACGCTGATCCCCTCCCCCCGGGGCCCGGACAGGCCCGGTGGCATCGAGGAGGAGGGCGGCGAGCAGGA
CCGCAAGCGCTCCACGCGCCTGGTGTCCGGCTTCCTGGCCCTGGTGTGGGACGACCTGCGCTCCCTGTGCCTGTTCCT
CTACCACGCCTGCGCGACTTCATCCTGATCGCGGCCCGCGCTGGCGAGCTGCTGGGCCGGTCCTCGCTGAAGGGCC
TGCGCCGCGGCTGGGAGGCCCTGAAGTACCTGGGCAGCCTGGTGCAGTACTGGGGCCTGGAGCTGAAGCGCTCCGC
CATCTCCCTGCTGGACACCCTGGCCATCGCCGTGGGCGAGGGCACCGACCGCATCCTGGAGTTCGTGCTGGGCATCT
GCCGCGCCATCCGCAACATCCCCACCCGCATCCGCCAGGGCTTCGAGACCGCCCTCCTGTGATGAGGTCACCGGGAC
C

MRVMGRQRNYPQWWIWSMLGLWMLMICNGMWVTVYYGVPVWKEAKTTLFCASDAKAYEKEVHNVWATHACVPT
DPNPQEMVLKNVTENFNMWKNDMVDQMHEDVISLWDQSLTPCVKLTPLCVTLNCTDANDTASNSSIKGMNNSIVGE
MKNCSFNITTELRDKREKKNALFYKLDIVQLDGNSSEYRLINCNTSVITQACPKVSFDPIPIHYCAPAGYAILKCNNKTFNGTG
PCNNVSTVQCTHGIKPVVSTQLLLNGSLAEGEIIRSENITDNAKTIIVHLNESVKIECTRPSNNTRTSIRIGPGQAFYATGQVI
GDIRKAHCNISESKWNETLQRVSKKLKEYFPDKNITFQPSSGGDPEITTHSFNCGGEFFYCNTSSLFNRTYMANSTDMANS
AETNSTRTITLHCRIKQIINMWQEVGRAMYAPPIAGNITCISNITGLLLTRDGGNSSTETETFRPGGGNMKDNWRSELYKYK
VVEVKPLGVAPTNARRRVVEREKRAVGMGAVFLGFLGAAGSTMGAASITLTVQARQLLSGIVQQQSNLLKAIEAQQHML
RLTVWGIKQLQARVLALERYLKDQQLLGMWGCSGKLICTTNVYWNSSWSNKTYDDIWDNMTWMQWEGEISNYTNIIY
DLLEESQNQQEKNEQDLLALDRWNSLWNWFNITNWLWYIKIFIMIVGGLIGLRIIFAVLSLVNRVRQGYSPLSLQTLIPSPR
GPDRPGGIEEEGGEQDRKRSTRLVSGFLALVWDDLRSLCLFLYHRLRDFILIAARAGELLGRSSLKGLRRGWEALKYLGSLVQ
YWGLELKRSAISLLDTLAIAVGEGTDRILEFVLGICRAIRNIPTRIRQGFETALL*

Figure 19B cont.

| Name | SEQ ID NO |
|---|---|
| >HV1301180, CH505TFchim.6R.SOSIP.664 | 195 |
| >HV1301181, CH505w53.16chim.6R.SOSIP.664 | 196 |
| >HV1301182, CH505w78.33 chim.6R.SOSIP.664 | 197 |
| >HV1301183, CH505w100.B6 chim.6R.SOSIP.664 | 198 |
| >HV1301143, CH505TFchim.DS.6R.SOSIP.664 | 199 |
| >HV1301144, CH505w53.16chim.DS.6R.SOSIP.664 | 200 |
| >HV1301145, CH505w78.33 chim.DS.6R.SOSIP.664 | 201 |
| >HV1301146, CH505w100.B6 chim.DS.6R.SOSIP.664 | 202 |
| >HV1301288, CH505M5chim.6R.SOSIP.664v4.1 | 203 |
| >HV1301297, CH505M5chim.6R.SOSIP.664v4.2 | 204 |
| >HV1301289, CH505M11chim.6R.SOSIP.664v4.1 | 205 |
| >HV1301298, CH505M11chim.6R.SOSIP.664v4.2 | 206 |
| >HV1301290, CH505w053.16.chim.6R.SOSIP.664v4.1 | 207 |
| >HV1301299, CH505w053.16.chim.6R.SOSIP.664v4.2 | 208 |
| >HV1301291, CH505w078.33.chim.6R.SOSIP.664v4.1 | 209 |
| >HV1301300, CH505w078.33.chim.6R.SOSIP.664v4.2 | 210 |
| >HV1301292, CH505w100.B6chim.6R.SOSIP.664v4.1 | 211 |
| >HV1301301, CH505w100.B6chim.6R.SOSIP.664v4.2 | 212 |
| >HV1301293, CH505w136.B18chim.6R.SOSIP.664v4.1 | 213 |
| >HV1301302, CH505w136.B18chim.6R.SOSIP.664v4.2 | 214 |

Figure 22B

| | |
|---|---|
| >HV1301294, CH505w20.14chim.6R.SOSIP.664v4.1 | 215 |
| >HV1301303, CH505w20.14chim.6R.SOSIP.664v4.2 | 216 |
| >HV1301295, CH505w30.12chim.6R.SOSIP.664v4.1 | 217 |
| >HV1301304, CH505w30.12chim.6R.SOSIP.664v4.2 | 218 |
| >HV1301296, CH505w30.20.chim.6R.SOSIP.664v4.1 | 219 |
| >HV1301305, CH505w30.20chim.6R.SOSIP.664v4.2 | 220 |
| >HV1301189, CH505TFchim.6R.SOSIP.664v4.1 | 221 |
| >HV1301190, CH505TFchim.6R.SOSIP.664v4.2 | 222 |
| >CH505w030.25chim.6R.SOSIP.664 | 223 |
| >CH505w030.25chim.DS.6R.SOSIP.664 | 224 |
| >CH505w030.25chim.6R.SOSIP.664v4.1 | 225 |
| >CH505w030.25chim.6R.SOSIP.664v4.2 | 226 |
| >CH505w053.25chim.6R.SOSIP.664 | 227 |
| >CH505w053.25chim.DS.6R.SOSIP.664 | 228 |
| >CH505w053.25chim.6R.SOSIP.664v4.1 | 229 |
| >CH505w053.25chim.6R.SOSIP.664v4.2 | 230 |
| >CH505w053.29chim.6R.SOSIP.664 | 231 |
| >CH505w053.29chim.6R.SOSIP.664v4.1 | 232 |
| >CH505w053.29chim.6R.SOSIP.664v4.2 | 233 |

Figure 22B cont.

| Name | SEQ ID NO |
|---|---|
| >HV1301180, CH505TFchim.6R.SOSIP.664 | 234 |
| >HV1301181, CH505w53.16chim.6R.SOSIP.664 | 235 |
| >HV1301182, CH505w78.33chim.6R.SOSIP.664 | 236 |
| >HV1301183, CH505w100.B6chim.6R.SOSIP.664 | 237 |
| >HV1301143, CH505TFchim.DS.6R.SOSIP.664 | 238 |
| >HV1301144, CH505w53.16chim.DS.6R.SOSIP.664 | 239 |
| >HV1301145, CH505w78.33chim.DS.6R.SOSIP.664 | 240 |
| >HV1301146, CH505w100chim.B6.DS.6R.SOSIP.664 | 241 |
| >HV1301288, CH505M5chim.6R.SOSIP.664v4.1 | 242 |
| >HV1301297, CH505M5chim.6R.SOSIP.664v4.2 | 243 |
| >HV1301289, CH505M11chim.6R.SOSIP.664v4.1 | 244 |
| >HV1301298, CH505M11chim.6R.SOSIP.664v4.2 | 245 |
| >HV1301290, CH505w053.16.chim.6R.SOSIP.664v4.1 | 246 |
| >HV1301299, CH505w053.16.chim.6R.SOSIP.664v4.2 | 247 |
| >HV1301291, CH505w078.33.chim.6R.SOSIP.664v4.1 | 248 |
| >HV1301300, CH505w078.33.chim.6R.SOSIP.664v4.2 | 249 |
| >HV1301292, CH505w100.B6chim.6R.SOSIP.664v4.1 | 250 |
| >HV1301301, CH505w100.B6chim.6R.SOSIP.664v4.2 | 251 |
| >HV1301293, CH505w136.B18chim.6R.SOSIP.664v4.1 | 252 |
| >HV1301302, CH505w136.B18chim.6R.SOSIP.664v4.2 | 253 |

Figure 23A

| | |
|---|---|
| >HV1301294, CH505w20.14chim.6R.SOSIP.664v4.1 | 254 |
| >HV1301303, CH505w20.14chim.6R.SOSIP.664v4.2 | 255 |
| >HV1301295, CH505w30.12chim.6R.SOSIP.664v4.1 | 256 |
| >HV1301304, CH505w30.12chim.6R.SOSIP.664v4.2 | 257 |
| >HV1301296, CH505w30.20.chim.6R.SOSIP.664v4.1 | 258 |
| >HV1301305, CH505w30.20chim.6R.SOSIP.664v4.2 | 259 |
| >HV1301189, CH505TFchim.6R.SOSIP.664v4.1 | 260 |
| >HV1301190, CH505TFchim.6R.SOSIP.664v4.2 | 261 |
| >CH505w030.25chim.6R.SOSIP.664 | 262 |
| >CH505w030.25chim.DS.6R.SOSIP.664 | 263 |
| >CH505w030.25chim.6R.SOSIP.664v4.1 | 264 |
| >CH505w030.25chim.6R.SOSIP.664v4.2 | 265 |
| >CH505w053.25chim.6R.SOSIP.664 | 266 |
| >CH505w053.25chim.DS.6R.SOSIP.664 | 267 |
| > CH505w053.25chim.6R.SOSIP.664v4.1 | 268 |
| > CH505w053.25chim.6R.SOSIP.664v4.2 | 269 |
| >CH505w053.29chim.6R.SOSIP.664 | 270 |
| >CH505w053.29chim.6R.SOSIP.664v4.1 | 271 |
| >CH505w053.29chim.6R.SOSIP.664v4.2 | 272 |

Figure 23A cont.

CH505TF chimera SOSIP.664.v4.1 (SOSIP.III) annotated

*Human CD5 leader sequence:* MPMGSLQPLATLYLLGMLVASVLA;

*Amino acids from strain* BG505;
Start of gp41 from BG505
Sequence between right and left arrows is from CH505 except for the v4.1 mutations
V4.1 mutation shows the position of the lysine mutation corresponding to E64K and the position of the A316W mutation (See de Taeye et al. (2015) Cell 163, 1702-1715.

```
CH505TF chimera SOSIP.664.v4.1  (648)  ------------------------------------------------
        HV1301003 CH505 TF gp160 (737)  ALVWDDLRSLCLFIYHRLRDFILIAARAGELLGRSSLKGLREGWEALKYL
              VRC4112 BG505 SOSIP (652)  ------------------------------------------------
                        Consensus (751)                                                350
                                                                          301

CH505TF chimera SOSIP.664.v4.1  (648)  ------------------------------------------------
        HV1301003 CH505 TF gp160 (787)  GSLVQYWGLELKRSAISLLDTLAIAVGEGTDRILEFVLGICRAIRNIPTR
              VRC4112 BG505 SOSIP (652)  ------------------------------------------------
                        Consensus (801)                                                861
                                                                          851

CH505TF chimera SOSIP.664.v4.1  (648)  ---------------
        HV1301003 CH505 TF gp160 (837)  IRQGFETALL----
              VRC4112 BG505 SOSIP (652)  ---------------
                        Consensus (851)  
```

Figure 23B cont.

>CH505TF.6R.SOSIP.664.v4.1_AMBRCTA (HV1301189_AMBRCTA)

Signal peptide; ▓▓▓▓▓▓▓▓▓▓▓▓▓▓▓; gp41 transmembrane and cytoplasmic tail)

ATGCCCATGGCCAGCCTGCAGCCCCTGGCCACCCTGTACCTGCTGGGCATGCTGGTGGCTAGCGTGCTGGCC
GCCGAGAACCTGTGGGTGACCGTCTACTATGGCGTGCCCGTCTGGAAGGAAGCCAAAACCACACTGTTCTGC
GCTAGCGACGCTAAGGCATACGAGAAAAAAGTGCACAATGTCTGGGCTACTCATGCATGCGTGCCTACCGAT
CCAAATCCCCAGGAGATGGTGCTGAAGAACGTCACAGAAAACTTTAATATGTGGAAGAACGACATGGTGGAT
CAGATGCACGAGGACGTGATCAGCCTGTGGGATCAGTCCCTGAAGCCATGCGTGAAACTGACTCCCCTGTGC
GTCACCCTGAACTGTACTAATGCCACCGCTTCCAACAGCTCCATCATTGAGGGGATGAAGAACTGTTCTTTC
AATATCACTACCGAGCTGCGCGACAAGCGAGAAAAGAAAAATGCCCTGTTTTACAAACTGGACATCGTGCAG
CTGGATGGCAACTCTAGTCAGTATAGACTGATTAACTGCAATACAAGCGTGATCACTCAGGCATGTCCAAAG
GTCAGTTTCGATCCTATTCCAATCCACTACTGCGCACCCGCCGGATATGCTATCCTGAAGTGTAACAACAAG
ACCTTCACCGGCACTGGGCCTTGCAACAACGTGAGCACCGTCCAGTGTACACATGGCATTAAGCCAGTGGTC
AGCACCCAGCTGCTGCTGAACGGCAGCCTGGCAGAGGGCGAAATCATTATCCGCAGCGAGAACATCACAAAT
AATGTGAAGACTATCATCGTCCACCTGAACGAGAGCGTGAAGATTGAATGCACACGGCCCAACAACAAGACC
AGGACATCCATTCGCATCGGACCTGGCCAGTGGTTCTACGCTACTGGCCAGGTCATCGGGGACATCAGAGAG
GCCTATTGTAACATCAATGAGTCAAAGTGGAATGAAACTCTGCAGAGGGTGAGCAAGAAACTGAAGGAATAC
TTCCCTCACAAAAACATCACCTTTCAGCCATCAAGCGGCGGGGACCTGGAGATTACAACTCATTCTTTCAAT
TGCGGAGGCGAATTCTTTTACTGTAACACCTCCTCTCTGTTTAATCGCACATATATGGCTAACAGTACTGAT
ATGGCAAACTCTACTGAGACCAATAGTACACGAACTATTACCATCCATTGCCGGATCAAGCAGATTATCAAC
ATGTGGCAGGAAGTGGGGCGGGCCATGTATGCTCCCCCTATTGCAGGAAATATTACCTGTATCAGCAACATT
ACCGGCCTGCTGCTGACAAGAGACGGGGGAAAGAACAATACAGAGACTTTTAGGCCTGGCGGGGGAAACATG
AAAGATAATTGGCGCTCCGAGCTGTACAAGTATAAAGTGGTCAAGATCGAACCACTGGGAGTGGCACCTACC
CGATGTAAACGGAGAGTGGTCGGAAGGCGCCGACGGAGAAGGGCAGTGGGAATCGGAGCCGTCTTCCTGGGC
TTTCTGGGAGCAGCTGGCAGCACAATGGGAGCAGCCTCTATGACCCTGACAGTGCAGGCTCGAAATCTGCTG
AGTGGGATCGTGCAGCAGCAGTCAAACCTGCTGCGAGCACCAGAGGCACAGCAGCATCTGCTGAAGCTGACC
GTGTGGGGCATCAAGCAGCTGCAGGCCAGAGTGCTGGCTGTCGAACGGTACCTGAGAGATCAGCAGCTGCTG
GGAATCTGGGGATGCAGCGGAAAGCTGATTTGCTGTACAAACGTGCCCTGGAATAGTTCATGGTCAAACAGG
AATCTGAGCGAGATCTGGGACAATATGACCTGGCTGCAGTGGGATAAGGAAATCAGTAACTACACAGATC
ATCTATGGCCTGCTGGAGGAATCACAGAACCAGCAGGAGAAAAATGAACAGGACCTGCTGGCCCTGGAT▓▓▓
▓▓▓AAGTGGGCAAGTCTGTGGAATTGGTTTGACATATCAAACTGGCTGTGGTATATAAAAATATTTATAATG
ATAGTAGGAGGCTTAATAGGATTAAGAATAGTTTTTGCTGTGCTTTCTGTAATACATAGAGTTAGGCAGGGA
TACTCACCTTTGTCGTTTCAGACCCATACCCCAAACCCAAGGGGACTCGACAGGCCCGAAAGAATCGAAGAA
GAAGATGGAGAGCAAGACAGAGGCAGATCGACGCGATTAGTGAGCGGATTCTTAGCTCTTGCCTGGGACGAT
CTGAGGAGCCTGTGCCTCTTCTGCTACCACCGATTGAGAGACTTCATCTTGATTGCAGCGAGGATTGTGGAA
CTTCTGGGACACAGCAGTCTCAAGGGGTTGAGACTGGGGTGGGAAGGCCTCAAGTATCTGTGGAATCTCCTG
GCATATTGGGGTCGGGAACTAAAAATTAGTGCTATTAATTTGTTTGATACCATAGCAATAGCAGTAGCTGAG
TGGACAGATAGGGTTATAGAAATAGGACAAAGACTTTGTAGAGCTTTTCTCCACATACCTAGAAGAATCAGA
CAGGGCCTCGAAAGGGCTTTGCTATAATAA

Figure 24A

>CH505TF.6R.SOSIP.664.v4.1_AMBRCTA (HV1301189_AMBRCTA)
MPMGSLQPLATLYLLGMLVASVLAAENLWVTVYYGVPVWKEAKTTLFCASDAKAYEKKVH
NVWATHACVPTDPNPQEMVLKNVTENFNMWKNDMVDQMHEDVISLWDQSLKPCVKLTPLC
VTLNCTNATASNSSIIEGMKNCSFNITTELRDKREKKNALFYKLDIVQLDGNSSQYRLIN
CNTSVITQACPKVSFDPIPIHYCAPAGYAILKCNNKTFTGTGPCNNVSTVQCTHGIKPVV
STQLLLNGSLAEGEIIIRSENITNNVKTIIVHLNESVKIECTRPNNKTRTSIRIGPGQWF
YATGQVIGDIREAYCNINESKWNETLQRVSKKLKEYFPHKNITFQPSSGGDLEITTHSFN
CGGEFFYCNTSSLFNRTYMANSTDMANSTETNSTRTITIHCRIKQIINMWQEVGRAMYAP
PIAGNITCISNITGLLLTRDGGKNNTETFRPGGGNMKDNWRSELYKYKVVKIEPLGVAPT
RCKRRVVGRRRRRRAVGIGAVFLGFLGAAGSTMGAASMTLTVQARNLLSGIVQQQSNLLR
APEAQQHLLKLTVWGIKQLQARVLAVERYLRDQQLLGIWGCSGKLICCTNVPWNSSWSNR
NLSEIWDNMTWLQWDKEISNYTQIIYGLLEESQNQQEKNEQDLLALDKWASLWNWFDI
SNWLWYIKIFIMIVGGLIGLRIVFAVLSVIHRVRQGYSPLSFQTHTPNPRGLDRPERIEE
EDGEQDRGRSTRLVSGFLALAWDDLRSLCLFCYHRLRDFILIAARIVELLGHSSLKGLRL
GWEGLKYLWNLLAYWGRELKTSAINLFDTTAIAVAEWTDRVIEIGQRICRAFIHIPRRIR
QGLERALL**

>CH505TF.6R.SOSIP.664.v4.1_AMBRCTAG (HV1301189_AMBRCTAG)

```
ATGGATGCAATGAAGAGAGGGCTCTGCTGTGTGCTGCTGCTGTGTGGAGCAGTCTTCGTT
GCCGAGAACCTGTGGGTGACCGTCTACTATGGCGTGCCCGTCTGGAAGGAAGCCAAAACCACACTGTTCTGC
GCTAGCGACGCTAAGGCATACGAGAAAAAAGTGCACAATGTCTGGGCTACTCATGCATGCGTGCCTACCGAT
CCAAATCCCCAGGAGATGGTGCTGAAGAACGTCACAGAAAACTTTAATATGTGGAAGAACGACATGGTGGAT
CAGATGCACGAGGACGTGATCAGCCTGTGGGATCAGTCCCTGAAGCCATGCGTGAAACTGACTCCCCTGTGC
GTCACCCTGAACTGTACTAATGCCACCGCTTCCAACAGCTCCATCATTGAGGGGATGAAGAACTGTTCTTTC
AATATCACTACCGAGCTGCGCGACAAGCGAGAAAAGAAAAATGCCCTGTTTTACAAACTGGACATCGTGCAG
CTGGATGGCAACTCTAGTCAGTATAGACTGATTAACTGCAATACAAGCGTGATCACTCAGGCATGTCCAAAG
GTCAGTTTCGATCCTATTCCAATCCACTACTGCGCACCCGCCGGATATGCTATCCTGAAGTGTAACAACAAG
ACCTTCACCGGCACTGGGCCTTGCAACAACGTGAGCACCGTCCAGTGTACACATGGCATTAAGCCAGTGGTC
AGCACCCAGCTGCTGCTGAACGGCAGCCTGGCAGAGGGCGAAATCATTATCCGCAGCGAGAACATCACAAAT
AATGTGAAGACTATCATCGTCCACCTGAACGAGAGCGTGAAGATTAATGCACACGGCCCAACAACAAGACC
AGGACATCCATTCGCATCGGACCTGGCCAGTGGTTCTACGCTACTGGCCAGGTCATCGGGGACATCAGAGAG
GCCTATTGTAACATCAATGAGTCAAAGTGGAATGAAACTCTGCAGAGGGTGAGCAAGAAACTGAAGGAATAC
TTCCCTCACAAAAACATCACCTTTCAGCCATCAAGCGGCGGGGACCTGGAGATTACAACTCATTCTTTCAAT
TGCGGAGGCGAATTCTTTTACTGTAACACCTCCTCTCTGTTTAATCGCACATATATGGCTAACAGTACTGAT
ATGGCAAACTCTACTGAGACCAATAGTACACGAACTATTACCATCCATTGCCGGATCAAGCAGATTATCAAC
ATGTGGCAGGAAGTGGGGCGGGCCATGTATGCTCCCCCTATTGCAGGAAATATTACCTGTATCAGCAACATT
ACCGGCCTGCTGCTGACAAGAGACGGGGGAAAGAACAATACAGAGACTTTTAGGCCTGGCGGGGGAAACATG
AAAGATAATTGGCGCTCCGAGCTGTACAAGTATAAAGTGGTCAAGATCGAACCACTGGGAGTGGCACCTACC
CGATGTAAACGGAGAGTGGTCGGAAGGCGCCGACGGAGAAGGGCAGTGGGAATCGGAGCCGTCTTCCTGGGC
TTTCTGGGAGCAGCTGGCAGCACAATGGGAGCAGCCTCTATGACCCTGACAGTGCAGGCTCGAAATCTGCTG
AGTGGGATCGTGCAGCAGCAGTCAAACCTGCTGCGAGCACCAGAGGCACAGCAGCATCTGCTGAAGCTGACC
GTGTGGGGCATCAAGCAGCTGCAGGCCAGAGTGCTGGCTGTCGAACGGTACCTGAGAGATCAGCAGCTGCTG
GGAATCTGGGGATGCAGCGGAAAGCTGATTTGCTGTACAAACGTGCCCTGGAATAGTTCATGGTCAAACAGG
AATCTGAGCGAGATCTGGGACAATATGACCTGGCTGCAGTGGGATAAGGAAATCAGTAACTACACAGATC
ATCTATGGCCTGCTGGAGGAATCACAGAACCAGCAGGAGAAAAATGAACAGGACCTGCTGGCCCTGGAT
AAGTGGGCAAGTCTGTGGAATTGGTTTGACATATCAAACTGGCTGTGGTATATAAAATATTTATA
ATGATAGTAGGAGGCTTAATAGGATTAAGAATAGTTTTTGCTGTGCTTTCTGTAATACATAGAGTTAGGCAG
GGATACTCACCTTTGTCGTTTCAGACCCATACCCCAAACCCAAGGGGACTCGACAGGCCCGAAAGAATCGAA
GAAGAAGATGGAGAGCAAGACAGAGGCAGATCGACGCGATTAGTGAGCGGATTCTTAGCTCTTGCCTGGGAC
GATCTGAGGAGCCTGTGCCTCTTCTGCTACCACCGATTGAGAGACTTCATCTTGATTGCAGCGAGGATTGTG
GAACTTCTGGGACACAGCAGTCTCAAGGGGTTGAGACTGGGGTGGGAAGGCCTCAAGTATCTGTGGAATCTC
CTGGCATATTGGGGTCGGGAACTAAAAATTAGTGCTATTAATTTGTTTGATACCATAGCAATAGCAGTAGCT
GAGTGGACAGATAGGGTTATAGAAATAGGACAAAGACTTTGTAGAGCTTTTCTCCACATACCTAGAAGAATC
AGACAGGGCCTCGAAAGGGCTTTGCTATAATAA
```

Figure 24A cont.

```
>CH505TF.6R.SOSIP.664.v4.1_AMBRCTAG(HV1301189_AMBRCTAG)
MPMGSLQPLATLYLLGMLVASVLAAENLWVTVYYGVPVWKEAKTTLFCASDAKAYEKKVH
NVWATHACVPTDPNPQEMVLKNVTENFNMWKNDMVDQMHEDVISLWDQSLKPCVKLTPLC
VTLNCTNATASNSSIIEGMKNCSFNITTELRDKREKKNALFYKLDIVQLDGNSSQYRLIN
CNTSVITQACPKVSFDPIPIHYCAPAGYAILKCNNKTFTGTGPCNNVSTVQCTHGIKPVV
STQLLLNGSLAEGEIIIRSENITNNVKTIIVHLNESVKIECTRPNNKTRTSIRIGPGQWF
YATGQVIGDIREAYCNINESKWNETLQRVSKKLKEYFPHKNITFQPSSGGDLEITTHSFN
CGGEFFYCNTSSLFNRTYMANSTDMANSTETNSTRTITIHCRIKQIINMWQEVGRAMYAP
PIAGNITCISNITGLLLTRDGGKNNTETFRPGGGNMKDNWRSELYKYKVVKIEPLGVAPT
RCKRRVVGRRRRRPAVGIGAVFLGFLGAAGSTMGAASMTLTVQARNLLSGIVQQQSNLLR
APEAQQHLLKLTVWGIKQLQARVLAVERYLRDQQLLGIWGCSGKLICCTNVPWNSSWSNR
NLSEIWDNMTWLQWDKEISNYTQIIYGLLEESQNQQEKNEQDLLALDKWASLWNWFD
ISNWLWYIKIFIMIVGGLIGLRIVFAVLSVIHRVRQGYSPLSFQTHTPNPRGLDRPERIE
EEGGEQDRGRSTRLVSGFLALAWDDLRSLCLFCYHRLRDFILIAARIVELLGHSSLKGLR
LGWEGLKYLWNLLAYWGREELKISAINLFDTIAIAVAEWTDRVIEIGQRLCRAFIHIPRRI
RQGLERALL**
```

Figure 24A cont.

>CH505M5chim.6R.SOSIP.664v4.1_AMBRCTA

GCCGAGAACCTGTGGGTGACCGTGTACTACGGCGTGCCCGTGTGGAAGGAGGCCAAGACCACCCTGTTCTGC
GCCTCCGACGCCAAGGCCTACGAGAAGAAGGTGCACAACGTGTGGGCCACCCACGCCTGCGTGCCCACCGAC
CCCAACCCCCAGGAGATGGTGCTGAAGAACGTGACCGAGAACTTCAACATGTGGAAGAACGACATGGTGGAC
CAGATGCACGAGGACGTGATCCTCCCTGTGGGACCAGTCCCTGAAGCCCTGCGTGAAGCTGACCCCCCTGTGC
GTGACCCTGAACTGCACCAACGCCACCGCCTCCAACTCCTCCATCATCGAGGGCATGAAGAACTGCTCCTTC
AACATCACCACCGAGCTGCGCGACAAGCGCGAGAAGAAGAACGCCCTGTTCTACAAGCTGGACATCGTGCAG
CTGGACGGCAACTCCTCCCAGTACCGCCTGATCAACTGCAACACCTCCGTGATCACCCAGGCCTGCCCCAAG
GTGTCCTTCGACCCCATCCCCATCCACTACTGCGCCCCCGCCGGCTACGCCATCCTGAAGTGCAACAACAAG
ACCTTCACCGGCACCGGCCCCTGCAACAACGTGTCCACCGTGCAGTGCACCCACGGCATCAAGCCCGTGGTG
TCCACCCAGCTGCTGCTGAACGGCTCCCTGGCCGAGGGCGAGATCATCATCCGCTCCGAGAACATCACCAAG
AACGTGAAGACCATCATCGTGCACCTGAACGAGTCCGTGAAGATCGAGTGCACCCGCCCCAACAACAAGACC
CGCACCTCCATCCGCATCGGCCCCGGCCAGTGGTTCTACGCCACCGGCCAGGTGATCGGCGACATCCGCGAG
GCCTACTGCAACATCAACGAGTCCAAGTGGAACGAGACCCTGCAGCGCGTGTCCAAGAAGCTGAAGGAGTAC
TTCCCCCACAAGAACATCACCTTCCAGCCCTCCTCCGGCGGCGACCTGGAGATCACCACCCACTCCTTCAAC
TGCGGCGGCGAGTTCTTCTACTGCAACACCTCCTCCCTGTTCAACCGCACCTACATGGCCAACTCCACCGAC
ATGGCCAACTCCACCGAGACCAACTCCACCCGCACCATCACCATCCACTGCCGCATCAAGCAGATCATCAAC
ATGTGGCAGGAGGTGGGCCGCGCCATGTACGCCCCCCCCATCGCCGGCAACATCACCTGCATCTCCAACATC
ACCGGCCTGCTGCTGACCCGCGACGGCGGCAAGAACAACACCGAGACCTTCCGCCCCGGCGGCGGCAACATG
AAGGACAACTGGCGCTCCGAGCTGTACAAGTACAAGGTGGTGAAGATCGAGCCCCTGGGCGTGGCCCCCACC
CGCTGCAAGCGCCGCGTGGTGGGCCGCCGCCGCCGCCGCCGCCGTGGGCATCGGCGCCGTGTTCCTGGGC
TTCCTGGGCGCCGCCGGCTCCACCATGGGCGCCGCCTCCATGACCCTGACCGTGCAGGCCCGCAACCTGCTG
TCCGGCATCGTGCAGCAGCAGTCCAACCTGCTGCGCGCCCCCGAGGCCCAGCAGCACCTGCTGAAGCTGACC
GTGTGGGGCATCAAGCAGCTGCAGGCCCGCGTGCTGGCCGTGGAGCGCTACCTGCGCGACCAGCAGCTGCTG
GGCATCTGGGGCTGCTCCGGCAAGCTGATCTGCTGCACCAACGTGCCCTGGAACTCCTCCTGGTCCAACCGC
AACCTGTCCGAGATCTGGGACAACATGACCTGGCTGCAGTGGGACAAGGAGATCTCCAACTACACCCAGATC
ATCTACGGCCTGCTGGAGGAGTCCCAGAACCAGCAGGAGAAGAACGAGCAGGACCTGCTGGCCCTGGAT
AAGTGGGCAAGTCTGTGGAATTGGTTTGACATATCAAACTGGCTGTGGTATATAAAAATATTTATAATG
ATAGTAGGAGGCTTAATAGGATTAAGAATAGTTTTTGCTGTGCTTTCTGTAATACATAGAGTTAGGCAGGGA
TACTCACCTTTGTCGTTTCAGACCCATACCCCAAACCCAAGGGGACTCGACAGGCCCGAAAGAATCGAAGAA
GAAGATGGAGAGCAAGACAGAGGCAGATCGACGCGATTAGTGAGCGGATTCTTAGCTCTTGCCTGGGACGAT
CTGAGGAGCCTGTGCCTCTTCTGCTACCACCGATTGAGAGACTTCATCTTGATTGCAGCGAGGATTGTGGAA
CTTCTGGGACACAGCAGTCTCAAGGGGTTGAGACTGGGGTGGGAAGGCCTCAAGTATCTGTGGAATCTCCTG
GCATATTGGGGTCGGGAACTAAAAATTAGTGCTATTAATTTGTTTGATACCATAGCAATAGCAGTAGCTGAG
TGGACAGATAGGGTTATAGAAATAGGACAAAGACTTTGTAGAGCTTTTCTCCACATACCCTAGAAGAATCAGA
CAGGGCCTCGAAAGGGCTTTGCTATAATAA
```

Figure 24A cont.

>CH505M5chim.6R.SOSIP.664v4.1_AMBRCTA

MPMGSLQPLATLYLLGMLVASVLAENLWVTVYYGVPVWKEAKTTLFCASDAKAYEKKVHNVWATHACVPTD
PNPQEMVLKNVTENFNMWKNDMVDQMHEDVISLWDQSLKPCVKLTPLCVTLNCTNATASNSSIIEGMKNCSF
NITTELRDKREKKNALFYKLDIVQLDGNSSQYRLINCNTSVITQACPKVSFDPIPIHYCAPAGYAILKCNNK
TFTGTGPCNNVSTVQCTHGIKPVVSTQLLLNGSLAEGEIIIRSENITKNVKTIIVHLNESVKIECTRPNNKT
RTSIRIGPGQWFYATGQVIGDIREAYCNINESKWNETLQRVSKKLKEYFPHKNITFQPSSGGDLEITTHSFN
CGGEFFYCNTSSLFNRTYMANSTDMANSTETNSTRTITIHCRIKQIINMWQEVGRAMYAPPIAGNITCISNI
TGLLLTRDGGKNNTETFRPGGGNMKDNWRSELYKYKVVKIEPLGVAPTRCKRRVVGRRRRRRAVGIGAVFLG
FLGAAGSTMGAASMTLTVQARNLLSGIVQQQSNLLRAPEAQQHLLKLTVWGIKQLQARVLAVERYLRDQQLL
GIWGCSGKLICCTNVPWNSSWSNRNLSEIWDNMTWLQWDKEISNYTQIIYGLLEESQNQQEKNEQDLLALD
KWASLWNWFDISNWLWYIKIFIMIVGGLIGLRIVFAVLSVIHRVRQGYSPLSFQTHTPNPRGLDRPERIEE
EDGEQDRGRSTRLVSGFLALAWDDLRSLCLFCYHRLRDFILIAARIVELLGHSSLKGLRLGWEGLKYLWNLL
AYWGRELKISAINLFDTIAIAVAEWTDRVIEIGQRLCRAFLHIPRRIRQGLERALL**

Figure 24A cont.

>CH505M5chim.6R.SOSIP.664v4.1_AMBRCTAG

```
GCCGAGAACCTGTGGGTGACCGTGTACTACGGCGTGCCCGTGTGGAAGGAGGCCAAGACCACCCTGTTCTGC
GCCTCCGACGCCAAGGCCTACGAGAAGAAGGTGCACAACGTGTGGGCCACCCACGCCTGCGTGCCCACCGAC
CCCAACCCCCAGGAGATGGTGCTGAAGAACGTGACCGAGAACTTCAACATGTGGAAGAACGACATGGTGGAC
CAGATGCACGAGGACGTGATCTCCCTGTGGGACCAGTCCCTGAAGCCCTGCGTGAAGCTGACCCCCCTGTGC
GTGACCCTGAACTGCACCAACGCCACCGCCTCCAACTCCTCCATCATCGAGGGCATGAAGAACTGCTCCTTC
AACATCACCACCGAGCTGCGCGACAAGCGCGAGAAGAAGAACGCCCTGTTCTACAAGCTGGACATCGTGCAG
CTGGACGGCAACTCCTCCCAGTACCGCCTGATCAACTGCAACACCTCCGTGATCACCCAGGCCTGCCCCAAG
GTGTCCTTCGACCCCATCCCCATCCACTACTGCGCCCCCGCCGGCTACGCCATCCTGAAGTGCAACAACAAG
ACCTTCACCGGCACCGGCCCCTGCAACAACGTGTCCACCGTGCAGTGCACCCACGGCATCAAGCCCGTGGTG
TCCACCCAGCTGCTGCTGAACGGCTCCCTGGCCGAGGGCGAGATCATCATCCGCTCCGAGAACATCACCAAG
AACGTGAAGACCATCATCGTGCACCTGAACGAGTCCGTGAAGATCGAGTGCACCCGCCCCAACAACAAGACC
CGCACCTCCATCCGCATCGGCCCCGGCCAGTGGTTCTACGCCACCGGCCAGGTGATCGGCGACATCCGCGAG
GCCTACTGCAACATCAACGAGTCCAAGTGGAACGAGACCCTGCAGCGCGTGTCCAAGAAGCTGAAGGAGTAC
TTCCCCCACAAGAACATCACCTTCCAGCCCTCCTCCGGCGGCGACCTGGAGATCACCACCCACTCCTTCAAC
TGCGGCGGCGAGTTCTTCTACTGCAACACCTCCTCCCTGTTCAACCGCACCTACATGGCCAACTCCACCGAC
ATGGCCAACTCCACCGAGACCAACTCCACCCGCACCATCACCATCCACTGCCGCATCAAGCAGATCATCAAC
ATGTGGCAGGAGGTGGGCCGCGCCATGTACGCCCCCCCCATCGCCGGCAACATCACCTGCATCTCCAACATC
ACCGGCCTGCTGCTGACCCGCGACGGCGGCAAGAACAACACCGAGACCTTCCGCCCCGGCGGCGGCAACATG
AAGGACAACTGGCGCTCCGAGCTGTACAAGTACAAGGTGGTGAAGATCGAGCCCCTGGGCGTGGCCCCCACC
CGCTGCAAGCGCCGCGTGGTGGGCCGCCGCCGCCGCCGCCGCCGTGGGCATCGGCGCCGTGTTCCTGGGC
TTCCTGGGCGCCGCCGGCTCCACCATGGGCGCCGCCTCCATGACCCTGACCGTGCAGGCCCGCAACCTGCTG
TCCGGCATCGTGCAGCAGCAGTCCAACCTGCTGCGCGCCCCCGAGGCCCAGCAGCACCTGCTGAAGCTGACC
GTGTGGGGCATCAAGCAGCTGCAGGCCCGCGTGCTGGCCGTGGAGCGCTACCTGCGCGACCAGCAGCTGCTG
GGCATCTGGGGCTGCTCCGGCAAGCTGATCTGCTGCACCAACGTGCCCTGGAACTCCTCCTGGTCCAACCGC
AACCTGTCCGAGATCTGGGACAACATGACCTGGCTGCAGTGGGACAAGGAGATCTCCAACTACACCCAGATC
ATCTACGGCCTGCTGGAGGAGTCCCAGAACCAGCAGGAGAAGAACGAGCAGGACCTGCTGGCCCTGGAT
AAGTGGGCAAGTCTGTGGAATTGGTTTGACATATCAAACTGGCTGTGGTATATAAAATATTTATA
ATCATAGTAGGAGGCTTAATAGGATTAAGAATAGTTTTTGCTGTGCTTTCTGTAATACATAGAGTTAGGCAG
GGATACTCACCTTTGTCGTTTCAGACCCATACCCCAAACCCAAGGGGACTCGACAGGCCCGAAAGAATCGAA
GAAGAAGATGGAGAGCAAGACAGAGGCAGATCGACGCGATTAGTGAGCGGATTCTTAGCTCTTGCCTGGGAC
GATCTGAGGAGCCTGTGCCTCTTCTGCTACCACCGATTGAGAGACTTCATCTTGATTGCAGCGAGGATTGTG
GAACTTCTGGGACACAGCAGTCTCAAGGGGTTGAGACTGGGGTGGGAAGGCCTCAAGTATCTGTGGAATCTC
CTGGCATATTGGGGTCGGGAACTAAAAATTAGTGCTATTAATTTGTTTGATACCATAGCAATAGCAGTAGCT
GACTGGACAGATAGGGTTATAGAAATAGGACAAAGACTTTGTAGAGCTTTTCTCCACATACCTAGAAGAATC
AGACAGGGCCTCGAAAGGGCTTTGCTATAATAA
```

Figure 24A cont.

>CH505M5chim.6R.SOSIP.664v4.1_AMBRCTAG

```
                          AENLWVTVYYGVPVWKEAKTTLFCASDAKAYEKKVHNVWATHACVPTD
PNPQEMVLKNVTENFNMWKNDMVDQMHEDVISLWDQSLKPCVKLTPLCVTLNCTNATASNSSIIEGMKNCSF
NITTELRDKREKKNALFYKLDIVQLDGNSSQYRLINCNTSVITQACPKVSFDPIPIHYCAPAGYAILKCNNK
TFTGTGPCNNVSTVQCTHGIKPVVSTQLLLNGSLAEGEIIIRSENITKNVKTIIVHLNESVKIECTRPNNKT
RTSIRIGPGQWFYATGQVIGDIREAYCNINESKWNETLQRVSKKLKEYFPHKNITFQPSSGGDLEITTHSFN
CGGEFFYCNTSSLFNRTYMANSTDMANSTETNSTRTITIHCRIKQIINMWQEVGRAMYAPPIAGNITCISNI
TGLLLTRDGGKNNTETFRPGGGNMKDNWRSELYKYKVVKIEPLGVAPTRCKRRVVGRRRRRRAVGIGAVFLG
FLGAAGSTMGAASMTLTVQARNLLSGIVQQQSNLLRAPEAQQHLLKLTVWGIKQLQARVLAVERYLRDQQLL
GIWGCSGKLICCTNVPWNSSWSNRNLSEIWDNMTWLQWDKEISNYTQIIYGLLEESQNQQEKNEQDLLALD
   KWASLWNWFDISNWLWYIKIFIMIVGGLIGLRIVFAVLSVIHRVRQGYSPLSFQTHTPNPPGLDRPEPIE
EEDGEQDRGRSTPLVSGFLALAWDDLPSLCLFCYHRLRDFILIAARIVELLGHSSLKGLRLGWEGLKYLWNL
LQYWGPELKISAINLFDTIAIAVAEWTDRVIEICQRLCRAFLHIPRRIRQGLERALL**
```

Figure 24A cont.

CH505M5chim.6R.SOSIP.664v4.1_AMBRCTA (1)
CH505TF chimera SOSIP.664.v4.1AMber stopCTA (1)
CH505M5chim.6R.SOSIP.664v4.1 AMBRCTAG (1)
CH505TF chimera SOSIP.664.v4.1AMber stopCTAG (1)
Consensus (1) MPMGSLQPLATLYLLGMLVASVLAAENLWVTVYYGVPVWKEAKTTLFCAS CH505M5chim.6R.SOSIP.664v4.1_AMBRCTA (51)
CH505TF chimera SOSIP.664.v4.1AMber stopCTA (51)
CH505M5chim.6R.SOSIP.664v4.1 AMBRCTAG (51)
CH505TF chimera SOSIP.664.v4.1AMber stopCTAG (51)
Consensus (51) DAKAYEKKVHNVWATHACVPTDPNPQEMVLKNVTENFNMWKNDMVDQMHE

Figure 24A cont.

```
                                            101                                                    150
CH505M5chim.6R.SOSIP.664v4.1_AMBRCTA       (101) ░░░░░░░░░░░░░░░░░░░░░░░░░░░░░░░░░░░░░░░░░░░░░░░░░
CH505TF chimera SOSIP.664.v4.1AMber stopCTA (101) ░░░░░░░░░░░░░░░░░░░░░░░░░░░░░░░░░░░░░░░░░░░░░░░░░
CH505M5chim.6R.SOSIP.664v4.1_AMBRCTAG      (101) ░░░░░░░░░░░░░░░░░░░░░░░░░░░░░░░░░░░░░░░░░░░░░░░░░
CH505TF chimera SOSIP.664.v4.1AMber stopCTAG (101) ░░░░░░░░░░░░░░░░░░░░░░░░░░░░░░░░░░░░░░░░░░░░░░░░
                                  Consensus (101) DVISLWDQSLKPCVKLTPLCVTLNCTNATASNSSIIEGMRNCSFNITTEL 151                                                    200
CH505M5chim.6R.SOSIP.664v4.1_AMBRCTA       (151) ░░░░░░░░░░░░░░░░░░░░░░░░░░░░░░░░░░░░░░░░░░░░░░░░░
CH505TF chimera SOSIP.664.v4.1AMber stopCTA (151) ░░░░░░░░░░░░░░░░░░░░░░░░░░░░░░░░░░░░░░░░░░░░░░░░░
CH505M5chim.6R.SOSIP.664v4.1_AMBRCTAG      (151) ░░░░░░░░░░░░░░░░░░░░░░░░░░░░░░░░░░░░░░░░░░░░░░░░░
CH505TF chimera SOSIP.664.v4.1AMber stopCTAG (151) ░░░░░░░░░░░░░░░░░░░░░░░░░░░░░░░░░░░░░░░░░░░░░░░░
                                  Consensus (151) RDKREKKNALFYKLDIVQLDGNSSQYRLINCNTSVITQACPKVSFDPIPI 201                                                    250
CH505M5chim.6R.SOSIP.664v4.1_AMBRCTA       (201) ░░░░░░░░░░░░░░░░░░░░░░░░░░░░░░░░░░░░░░░░░░░░░░░░░
CH505TF chimera SOSIP.664.v4.1AMber stopCTA (201) ░░░░░░░░░░░░░░░░░░░░░░░░░░░░░░░░░░░░░░░░░░░░░░░░░
CH505M5chim.6R.SOSIP.664v4.1_AMBRCTAG      (201) ░░░░░░░░░░░░░░░░░░░░░░░░░░░░░░░░░░░░░░░░░░░░░░░░░
CH505TF chimera SOSIP.664.v4.1AMber stopCTAG (201) ░░░░░░░░░░░░░░░░░░░░░░░░░░░░░░░░░░░░░░░░░░░░░░░░
                                  Consensus (201) HYCAPAGYAILKCNNKTFTGTGPCNNVSTVQCTHGIKPVVSTQLLLNGSL
```

CH505M5chim.6R.SOSIP.664v4.1_AMBRCTA (848) :
CH505TF chimera SOSIP.664.v4.1AMber stopCTA (848) :
CH505M5chim.6R.SOSIP.664v4.1_AMBRCTAG (849) :
CH505TF chimera SOSIP.664.v4.1AMber stopCTAG (849) :
Consensus (851) 851

Figure 24A cont.

Found BG505 sequence in genbank DQ208458.1

```
         M   R   V   M   G   I   Q   R   M   C   Q   H   L   F   R   W   G   T   M   I   L   G   M   I   I   I   C   S   A   A   E   N   L   W   .
  1 ATGAGAGTGA TGGGGATACA GAGGAATTGT CAGGCACTTAT TCAGATGGGG AACTATGATC TTGGGATGAT AATAATTTG TAGTGCAGCA GAAAACTTGT
    TACTCTCACT ACCCCTATGT CTCCTTAACA GTCGTGAATA AGTCTACCCC TTGATACTAG ATTATTAAAC ATTACGTCGT CTTTTGAACA

V   T   V   Y   Y   G   V   P   V   W   K   D   A   E   T   T   L   F   C   A   S   D   A   K   A   Y   E   T   E   K   H   N   V   .
101 GGGTCACTGT CTACTATGGG GTACCTGTGT GGAAAGGACGC AGAGACCACC TTATTTTGTG CATCAGATGC TAAAGCATAT GAGACAGAAA AGCATAATGT
    CCCAGTGACA GATGATACCC CATGGACACA CCTTTCTGCG TCTCTGTGG AATAAAACAC GTAGTCTACG ATTTCGTATA CTCTGTCTTT TCGTATTACA

W   A   T   H   A   C   V   P   T   D   P   N   P   Q   E   I   H   L   E   N   V   T   E   E   F   N   M   W   K   N   N   M   V   .
201 CTGGGCTACA CATGCCTGTG TACCCACAGA CCCCAACCCA CAAGAAATAC ATTTGGAAAA TGTGACTGAA GAGTTTAACA TGTGGAAAAA TAACATGGTA
    GACCCGATGT GTACGGACAC ATGGGTGTCT GGGGTTGGGT GTTCTTTATG TAAACCTTTT ACACTGACTT CTCAAATTGT ATGTACCAT

E   Q   M   H   T   D   I   I   S   L   W   D   Q   S   L   K   P   C   V   K   L   T   P   L   C   V   T   L   Q   C   T   N   V   T   .
301 GAGCAGATGC ATACAGATAT CATCAGTCTA TGGGACCAAA GCCTAAAGCC ATGTGTAAAG CTCACCCCTC TCTGTGTTAC TCTACAGTGT ACCAATGTCA
    CTCGTCTACG TATGTCTATA GTAGTCAGAT ACCCTGGTTT CGGATTTCGG TACACATTTC AGAGCCAATG AGACGCCAATG TGGTTACAGT

N   M   I   T   D   D   M   R   G   E   L   K   N   C   S   F   N   M   T   T   E   L   R   D   K   K   Q   K   V   Y   S   L   F   .
401 CCAATAATGA TACACAGATGAC ATGAGGGGAG AATTAAAAAA CTGCTCTTTC AATATGACCA CAGAGCTAAG GGATAAGAAA CAGAAGGTTT ATTCACTTTT
    GGTTATTATA CACTGCTACTG TACTCCCCTC TTAATTTTTT GACGAGAAAG TTATGGTGGT GTCTCGATTC CCTATTCTTT GTCTTCCAAA TAAGTGAAAA

Y   R   L   D   V   V   Q   I   N   E   N   Q   G   N   R   S   N   N   S   N   K   E   Y   R   L   I   N   C   N   T   S   A   I   .
501 TTATAGAGCTA GATGATGTTA GAATTAACGA AAATCAAGGA AATAGAGGTA AAATAAATGA GAATCAAGGA CAAGGAGTAT CCTAATATAC CTCCAGCATT
    AATATCGAT CTACACTTCATG TTAATTGCT CTTAGTTCCA TTATCCCATTAT GTCCTCATCA TAATTATAT TAACATTATG GAGTCGGTAA
```

```
       E  V  T  T  H  S  F  N  C  G  G  E  F  F  Y  C  N  T  S  G  L  F  N  S  T  W  I  S  N  T  S  V  Q
1101   AGAAGTCACA ACACATAGTT TTAATGTGTG AGGAGAATTT TTCTATTGTA ACAACATCAGG CCTGTTCAAT AGCACTTGGA TTAGCAATAC CAGGGTGCAG
       TCTTCAGTGT TGTGTATCAA AATTACACAC TCCTCTTAAA AAGATAACAT TGTGTAGTCC GGACAAGTTA TCGTGAACCT AATCGTTATG GTCGCACGTC
       G  S  N  S  T  G  S  N  D  S  I  T  L  F  C  R  I  K  Q  I  I  N  M  W  Q  R  I  G  Q  A  M  Y  A  P
1201   GGGTCAAATA GCACGGGGTC AAATGACAGT CATGCAGAAT AAAACTCTCT TTTGCAGAAT ATAAACAAATT ATAAATATGT GGCAGAGAAT AGGACAAGCA ATGTATGCCC
       CCCAGTTTAT CGTGCCCCAG TTTACTGTCA GTACGTCTTA TATTTGAGAGG AAACGTCTTA TATTTATACA CCGTCTCTTA TCCTGTTCGT TACATACGGG
       P  I  Q  G  V  I  R  C  V  S  N  I  T  G  L  I  L  T  R  D  G  G  S  T  N  S  T  T  E  T  F  R  P
1301   CTCCCATTCA AGGAGTGTAT CAAACATTAC AGGGCTAATA TTAACAAGAG ATGGTGGGAG TACTAAAGAGT ACAACTGAAA CCTTCAGACC
       GAGGGTAAGT TCCTCACATA GTTTGTAATG TCCCGATTAT AATTGTTCTC TACCACCCTC ATGATTATCA TGTTGACTTT GGAAGTCTGG
       G  G  G  D  M  R  D  N  W  R  S  E  L  Y  K  Y  K  V  V  K  I  E  P  L  G  V  A  P  T  R  A  K  R
1401   TGGAGGAGGA GATATGAGGG ACAATTGGAG AAGTGAATTA TATAAATATA ATATTCATAT TTCACTTAAG AATTGAACCA CTAGGAGTAG CACCCACCAG GGCAAGAGAGA
       ACCTCCTCCT CTATACTCCC TGTTAACCTC TTCACTTAAT ATATTTATAT TATAAGTATA AAGTGAATTC TTAACTTGGT GATCCTCATC GTGGGTGGTC CCGTTCTCT
       R  V  G  R  E  K  R  A  V  G  I  G  A  V  F  L  G  F  L  G  A  A  G  S  T  M  G  A  A  S  M  T  L
1501   AGAGTGGTGG GGAGAGAAAA AGAGAGCAGT TGGAATAGGAG GGAATAGGAG CTGTCTTCCT TGGGTTCTTA GGAGCAGCAG GAAGCACTAT GGGCGCGGCG TCAATGACGC
       TCTCACCACC CCTCTCTTTT TCTCGTCA CCTTATCCTC GACAGAAGGA ACCCAAGAAT CCTCGTCGTC CTTCGTGATA CCCGCGCCGC AGTTACTGCG
       T  V  Q  A  R  N  L  L  S  G  I  V  Q  Q  S  N  L  L  R  A  I  E  A  Q  Q  H  L  L  K  L  T  V
1601   TGACGGTACA GGCCAGAAAT TTATTATCTG GCATAGTGCA ACAGCAAAGC AATTTGCTGA GGGCTATAGA GGCGCAACAA CATCTGTTGA AACTCACGGT
       ACTGCCATGT CCGGTCTTTA AATAATAGAC CGTATCACGT TGTCGTTTCG TTAAACGACT CCCGATATCT CCGCGTTGTT GTAGACAACT TTGAGTGCCA
       W  G  I  K  Q  L  Q  A  R  V  L  A  V  E  R  Y  L  R  D  Q  Q  L  L  G  I  W  G  C  S  G  K  L  I
1701   CTGGGGCATT AAAACAGCTCC AGGCAAGGGT CCTGGCTGTG GAAAGATACC TAAGGGATCA ACAGCTTCTA GGAATTTGGG GCTGCTCTGG AAAACTCATC
       GACCCCGTAA TTTTCGTCGAGG TCCGTTCCCA GGACCGACAC CTTTCTATGG ATTCCCTAGT TGTCGAAGAT CCTTAAACCC CGACGAGACC TTTGAGTAG
```

Found amber codon read through motif (UGACTTAG) in Loughran atkins et al Nucleic acid research 2014.

CH505TF chimera SOSIP.664.v

Figure 24A cont.

```
       .  Q  C  T  H  G  I  K  P  V  V  S  T  Q  L  L  M  G  S  L  A  E  G  E  I  I  R  S  E  N  I  T
 701   CCAGTGTACA CATGGCATTA AGCCAGTGGT CAGCACCCAG CTGCTGCTGA ACGGCAGCCT GGCAGAGGGC GAAATCATTA TCCGCAGCGA GAATCAACA
       GGTCACATGT GTACCGTAAT TCGGTCACCA GTCGTGGGTC GACGACGACT TGCCGTCGGA CCGTCTCCCG CTTTAGTAAT AGGCGTCGCT CTTGTAGTGT

N  N  V  K  T  I  I  V  H  L  N  E  S  V  K  I  E  C  T  R  P  N  K  T  R  T  S  I  R  I  G  P  G  .
 801   AATAATGTGA AGACTATCAT CGTCCACCTG AACGAGAGCG TGAAGATTGA ATGCACACGG CCCAACAACA AGACCAGGAC ATCCATTCGC ATCGGACCTG
       TTATTACACT TCTGATAGTA GCAGGTGGAC TTGCTCTCGC ACTTCTAACT TACGTGTGCC GGGTTGTTGT TCTGGTCCTG TAGGTAAGCG TAGCCTGGAC
                                                                                                        PstI

.  Q  W  F  Y  A  T  G  Q  V  I  G  D  I  R  E  A  Y  C  N  I  N  E  S  K  W  N  E  T  L  Q  R  V  S  .
 901   GCCAGTGGTT CTACGCTACT GGCCAGGTCA TCGGGGACAT CAGAGAGGCC TATTGTAACA TCAATGAGTC AAAGTGGAAT GAAACTCTGC AGAGGGTGAG
       CGGTCACCAA GATGCGATGA CCGGTCCAGT AGCCCCTGTA GTCTCTCCGG ATAACATTGT AGTTACTCAG TTTCACCTTA CTTTGAGACG TCTCCCACTC

.  K  K  L  K  E  Y  F  P  H  K  N  I  T  F  Q  P  S  S  G  G  D  L  E  I  T  T  H  S  F  N  C  G  G
1001   CAAGAAACTG AAGGAATACT TCCCTCACAA AAACATCACC TTTCAGCCAT CAAGCGGCGG GGACCTGGAG ATTACAACTC ATTCTTTCAA TTGCGGAGGC
       GTTCTTTGAC TTCCTTATGA AGGGAGTGTT TTTGTAGTGG AAAGTCGGTA GTTCGCCGCC CCTGGACCTC TAATGTTGAG TAAGAAAGTT AACGCCTCCG
       EcoRI

.  E  F  F  Y  C  N  T  S  S  L  F  N  R  Y  M  A  N  S  T  D  M  A  N  S  T  E  T  N  S  T  R  E  I  .
1101   GAATTCTTTT ACTGTAACAC CTCCTCTCTG TTTAATCGCA CATATATGGC TAACAGTACT GATATGGCAA ACTCTACTGA GACCAATAGT ACACGAACTA
       CTTAAGAAAA TGACATTGTG GAGGAGAGAC AAATTAGCGT GTATATACCG ATTGTCATGA CTATACCGTT TGAGATGACT CTGGTTATCA TGTGCTTGAT
```

```
      . T V Y Q V P V W K E A K T L F C A S D A K A Y E K K V H N V W
  1   GACCGTCTAC TATGCCGTGC CCGTCTGGAA GGAAGCCAAA ACCACACTGT TCTGCGCTAG CGACGCTAAG GCATACGAGA AAAAAGTGCA CAATGTCTGG
      A T H A C V P T D P N P Q E M V L K N V T E N F N M W K N D M V D Q .
 101  CTGGCAGATG ATACCGCACG GGCAGAGACC CCTTCGGTTT TGGTGTGACA AGACGCGATC CGTGCGGATC CGTATGCTCT TTTTCACGTT GTTACAGACC
      . M H E D V I S L W D Q S L K P C V K L T P L C V T L N C T N A T A .
 201  GCTACTCATG CATGCCGTGC TACCGATCCA AATCCCCAGG AGATGGTGCT GAAGAACGTC ACAGAAAACT TTAATATGTG GAAGAACGAC ATGGTGGATC
      . S N S S I I E G M K N C S F N I T T E L R D K R E K K N A L F Y K
 301  AGATGCACGA GGATGTGATC AGCCTGTGGG ATCAGTCCCT GAAGCCATGC GTCACCCTG CGTCACCCTG GGAC TGACATGAT TACGGTGGCG
      . L D I V Q L D G N S S Q Y R L I N C N T S V I T Q A C P K V S F D P .
 401  TTCCAACAGC TCCATCATTG AGGGGATGAA GAACTGTTCT TTCAATATCA CTACCGAGCT GCGCGACAAG CGAGAAAAGA AAAATGCCCT GTTTTACAAA
      . I P I H Y C A P A G Y A I L K C N N K T F T G T G P C M N V S T V .
 501  CTGGACATCG TGCAGCTGGA TGGCAACTCT AGTCAGTATC GCCTGATTAA CTGCAATACA TCGGTTATTA CCCAAGCTTG TCCAAAGGTC TCAAAGGTAG
 601  CTATTCCAAT CCACTACTGC GCACCCGGCG GATATGCTAT CCTGAAGTGT AACAACAAGA CCTTCACCGG CACTGGGCCT TGCAACAACG TGAGCACCGT
      GATAAGGTTA GGTGATGACG CGTGGGGGC CTATACGATA GGACTTCACA TGTTGTTCT GGAAGTGGCC GTGACCCGGA ACGTTGTTGC ACTCGTGGCA
```

```
         . T  I  H  C  R  I  K  Q  I  I  N  M  W  Q  E  V  G  R  A  M  Y  A  P  P  I  A  G  N  I  T  C  I  S .
1201  TTACCATCCA TTGCCGGATC AAGCAGATTA TCAACATGTG GCAGGAAGTG GGGCGGGGCCA TGTATGCTCC CCCTATTGCA GGAAATATTA CCTGTATCAG
      AATGGTAGGT AACGGCCTAG TTCGTCTAAT AGTTGTACAC CGTCCTTCAC CCCGCCCGGT ACATACGAGG GGGATAACGT CCTTTATAAT GGACATAGTC

. N  I  T  G  L  L  L  T  R  D  G  G  K  N  N  T  E  F  F  R  P  G  G  G  N  M  K  D  N  W  R  S  E .
1301  CAATCATTACC GGGCTGCTGC TGACAAGGACG CGGGGGAAAG AACAATACAC AGAGTTTTTAG GCCTGGGCGG GGAAACATGA AAGATAATTG GCGCTCCGAG
      GTTGTAATGG CCGGACGACG ACTGTCTCTG CCCCCCCTTTC TTGTTATGTC TCTGAAAATC CGGACCCGCCC CCTTTGTACT TTCTATTAAC CGCGAGGCTC

. L  Y  K  V  V  K  I  E  P  L  G  V  A  P  T  R  C  K  R  V  V  G  R  R  R  R  A  V  G .
1401  CTGTACAAGT ATAAAGTGGT CAAGATCGAA CCACTGGGAG TGGCACCTAC CCGATGTAAA CGGAGAGTGG TCGGAAGCCG CCGGACGGAGA AGGGCAGTGG
      GACATGTTCA TATTTCACCA GTTCTAGCTT GGTGACCCTC ACCGTGGATG GGCTACATTT GCCTCTCACC AGCCTTCCGG GGCTGCCTCT TCCCGTCACC

. I  G  A  V  F  L  G  F  L  G  A  A  G  S  T  M  G  A  A  S  M  T  L  T  V  Q  A  R  N  L  L  S  G .
1501  GAATCGGAGC CGTCTTCCTG GGCTTTCTGG GAGCAGCTGG CAGCACAATG GGAGCAGCCT CTATGACCCT GACAGTGCAG GCTCGAAATC TGCTGAGTGG
      CTTAGCCTCG GCAGAAGGAC CCGAAAGACC CTCGTCGACC GTCGTCGTTAC CCTCGTCGGA GATACTGGGA CTGTCACGTC CGAGCTTTAG ACGACTCACC
                                                                                                           PstI
                                                                                                     ---------

. I  V  Q  Q  Q  S  N  L  L  R  A  P  E  A  Q  Q  H  L  L  K  L  T  V  W  G  I  K  Q  L  Q  A  R  V
1601  GATCGTGCAG CAGCAGTCAA CCTGCTGCGC AACCTGCTGG AGCACCAGAG GCACAGCAGC ATCTGGCTGAA GCTGACCGTG TGGGGCATCA AGCAGCTGCA GGCCAGAGTG
      CTAGCACGTC GTCGTCAGTT GGACGACGCG TTGGACGACC CGTCTGCTCG TAGACCGACTT CGACTGGCACT CGACTGGCAC ACCCCCGTAGT TCGTCGACGT CCGGTCTCAC
```

Figure 24A cont.

```
         L  A  V  E  R  Y  L  R  D  Q  Q  L  L  G  I  W  G  C  S  G  K  L  I  C  C  T  N  V  P  W  N  S  S  W  .
1701  CTGGCTGTCG AACGGTACCT GAGAGATCAG CAGCTGCTGG GAATCTGGGG ATGCAGCGGA AAGCTGATTT GCTGCACAAA CGTGCCCTGG AATAGTTCAT
      GACCGACAGC TTGCCATGGA CTCTCTAGTC GTCGACGACC CTTAGACCCC TACGTCGCCT TTCGACTAAA CGACGTGTTT GCACGGGACC TTATCAAGTA
                                                            PstI
                                                            ~~~~~~

.  S  N  R  N  L  S  E  I  W  D  N  M  T  W  L  Q  W  D  K  E  I  S  N  Y  T  Q  I  I  Y  G  L  L  E  .
1801  GGTCAAACAG GAATCTGAGC GAGATCTGGG ACAATATGAC CTGGCTGCAG TGGGATAAGG AAATCAGTAA CTACACACAG ATCATCTATG GCCTGCTGGA
      CCAGTTTGTC CTTAGACTCG CTCTAGACCC TGTTATACTG GACCGACGTC ACCCTATTCC TTTAGTCATT GATGTGTGTC TAGTAGATAC CGGACGACCT

.  E  S  Q  N  Q  Q  E  K  N  E  Q  D  L  L  A  L  D  *  L  K  W  A  S  L  N  W  F  D  I  S  N  W
1901  GGAATCACAG AACCAGCAAG AGAAAAATGA ACAGGACCTG CTGGCCCTGG ATTGA
```

Figure 24A cont.

CH505TF chimera SOSIP.664.v4.1AMber stopCTAG

Add CTAG GC (Leu Gly) after the amber stop codon UGA

```
  1 MPMGSLQPLA TLYLLGMLVA SVLAAENLWV TVYYGVPVWK EAKTTLFCAS
 51 DAKAYEKKVH NVWATHACVP TDPNPQEMVL KNVTENFNMW KNDMVDQMHE
101 DVISLWDQSL KPCVKLTPLC VTLNCTNATA SNSSIIEGMK NCSFNITTEL
151 RDKREKKNAL FYKLDIVQLD GNSSQYRLIN CNTSVITQAC PKVSFDPIPI
201 HYCAPAGYAI LKCNNKTFTG TGPCNNVSTV QCTHGIKPVV STQLLLNGSL
251 AEGEIIIRSE NITNNVKTII VHLNESVKIE CTRPNNKTRT SIRIGPGQWF
301 YATGQVIGDI REAYCNINES KWNETLQRVS KKLKEYFPHK NITFQPSSGG
351 DLEITTHSFN CGGEFFYCNT SSLFNRTYMA NSTDMANSTE TNSTRTITIH
401 CRIKQIINMW QEVGRAMYAP PIAGNITCIS NITGLLLTRD GGKNNTETFR
451 PGGGNMKDNW RSELYKYKVV KIEPLGVAPT RCKRRVVGRR RRRRAVGIGA
501 VFLGFLGAAG STMGAASMTL TVQARNLLSG IVQQQSNLLR APEAQQHLLK
551 LTVWGIKQLQ ARVLAVERYL RDQQLLGIWG CSGKLICCTN VPWNSSWSNR
601 NLSEIWDNMT WLQWDKEISN YTQIIYGLLE ESQNQQEKNE QDLLALD*LG
651 KWASLWNWFD ISNWLWYIKI FIMIVGGLIG LRIVFAVLSV IHRVRQGYSP
701 LSFQTHTPNP RGLDRPERIE EEDGEQDRGR STRLVSGFLA LAWDDLRSLC
751 LFCYHRLRDF ILIAARIVEL LGHSSLKGLR LGWEGLKYLW NLLAYWGREL
801 KISAINLFDT IAIAVAEWTD RVIEIGQRLC RAFLHIPRRI RQGLERALL*
851 *
```

Figure 24A cont.

```
CH505TF chimera SOSIP.664.v4.1AMber stopCTA

Add CTA (Leu) after the amber stop codon UGA

1  MPMGSLQPLA  TLYLLGMLVA  SVLAAENLWV  TVYYGVPVWK  EAKTTLFCAS
  51  DAKAYEKKVH  NVWATHACVP  TDPNPQEMVL  KNVTENFNMW  KNDMVDQMHE
 101  DVISLWDQSL  KPCVKLTPLC  VTLNCTNATA  SNSSIIEGMK  NCSFNITTEL
 151  RDKREKKNAL  FYKLDIVQLD  GNSSQYRLIN  CNTSVITQAC  PKVSFDPIPI
 201  HYCAPAGYAI  LKCNNKTFTG  TGPCNNVSTV  QCTHGIKPVV  STQLLLNGSL
 251  AEGEIIIRSE  NITNNVKTII  VHLNESVKIE  CTRPNNKTRT  SIRIGPGQWF
 301  YATGQVIGDI  REAYCNINES  KWNETLQRVS  KKLKEYFPHK  NITFQPSSGG
 351  DLEITTHSFN  CGGEFFYCNT  SSLFNRTYMA  NSTDMANSTE  TNSTRTITIH
 401  CRIKQIINMW  QEVGRAMYAP  PIAGNITCIS  NITGLLLTRD  GGKNNTETFR
 451  PGGGNMKDNW  RSELYKYKVV  KIEPLGVAPT  RCKRRVVGRR  RRRRAVGIGA
 501  VFLGFLGAAG  STMGAASMTL  TVQARNLLSG  IVQQQSNLLR  APEAQQHLLK
 551  LTVWGIKQLQ  ARVLAVERYL  RDQQLLGIWG  CSGKLICCTN  VPWNSSWSNR
 601  NLSEIWDNMT  WLQWDKEISN  YTQIIYGLLE  ESQNQQEKNE  QDLLALD*LK
 651  WASLWNWFDI  SNWLWYIKIF  IMIVGGLIGL  RIVFAVLSVI  HRVRQGYSPL
 701  SFQTHTPNPR  GLDRPERIEE  EDGEQDRGRS  TRLVSGFLAL  AWDDLRSLCL
 751  FCYHRLRDFI  LIAARIVELL  GHSSLKGLRL  GWEGLKYLWN  LLAYWGRELK
 801  ISAINLFDTI  AIAVAEWTDR  VIEIGQRLCR  AFLHIPRRIR  QGLERALL**
```

Figure 24A cont.

>CH505TF chimera SOSIP.664.v4.1 C-SORTA (HV1301189_C_SORTAv2)

ATGCCCATGGGCAGCCTGCAGCCCCTGGCCACCCTGTACCTGCTGGGCATGCTGGTGGCTAGCGTGCTGGC
GGCCGAGAACCTGTGGGTGACCGTCTACTATGGCGTGCCCGTCTGGAAGGAAGCCAAAACCACACTGTTCT
GCGCTAGCGACGCTAAGGCATACGAGAAAAAAGTGCACAATGTCTGGGCTACTCATGCATGCGTGCCTAC
CGATCCAAATCCCCAGGAGATGGTGCTGAAGAACGTCACAGAAAACTTTAATATGTGGAAGAACGACATG
GTGGATCAGATGCACGAGGACGTGATCAGCCTGTGGGATCAGTCCCTGAAGCCATGCGTGAAACTGACTC
CCCTGTGCGTCACCCTGAACTGTACTAATGCCACCGCTTCCAACAGCTCCATCATTGAGGGGATGAAGAACT
GTTCTTTCAATATCACTACCGAGCTGCGCGACAAGCGAGAAAAGAAAAATGCCCTGTTTTACAAACTGGAC
ATCGTGCAGCTGGATGGCAACTCTAGTCAGTATAGACTGATTAACTGCAATACAAGCGTGATCACTCAGGC
ATGTCCAAAGGTCAGTTTCGATCCTATTCCAATCCACTACTGCGCACCCGCCGGATATGCTATCCTGAAGTG
TAACAACAAGACCTTCACCGGCACTGGGCCTTGCAACAACGTGAGCACCGTCCAGTGTACACATGGCATTA
AGCCAGTGGTCAGCACCCAGCTGCTGCTGAACGGCAGCCTGGCAGAGGGCGAAATCATTATCCGCAGCGA
GAACATCACAAATAATGTGAAGACTATCATCGTCCACCTGAACGAGAGCGTGAAGATTGAATGCACACGGC
CCAACAACAAGACCAGGACATCCATTCGCATCGGACCTGGCCAGTGGTTCTACGCTACTGGCCAGGTCATC
GGGGACATCAGAGAGGCCTATTGTAACATCAATGAGTCAAAGTGGAATGAAACTCTGCAGAGGGTGAGCA
AGAAACTGAAGGAATACTTCCCTCACAAAAACATCACCTTTCAGCCATCAAGCGGCGGGGACCTGGAGATT
ACAACTCATTCTTTCAATTGCGGAGGCGAATTCTTTTACTGTAACACCTCCTCTCTGTTTAATCGCACATATAT
GGCTAACAGTACTGATATGGCAAACTCTACTGAGACCAATAGTACACGAACTATTACCATCCATTGCCGGAT
CAAGCAGATTATCAACATGTGGCAGGAAGTGGGGCGGGCCATGTATGCTCCCCCTATTGCAGGAAATATTA
CCTGTATCAGCAACATTACCGGCCTGCTGCTGACAAGAGACGGGGGAAAGAACAATACAGAGACTTTTAG
GCCTGGCGGGGGAAACATGAAAGATAATTGGCGCTCCGAGCTGTACAAGTATAAAGTGGTCAAGATCGAA
CCACTGGGAGTGGCACCTACCCGATGTAAACGGAGAGTGGTCGGAAGGCGCCGACGGAGAAGGGCAGTG
GGAATCGGAGCCGTCTTCCTGGGCTTTCTGGGAGCAGCTGGCAGCACAATGGGAGCAGCCTCTATGACCCT
GACAGTGCAGGCTCGAAATCTGCTGAGTGGGATCGTGCAGCAGCAGTCAAACCTGCTGCGAGCACCAGAG
GCACAGCAGCATCTGCTGAAGCTGACCGTGTGGGGCATCAAGCAGCTGCAGGCCAGAGTGCTGGCTGTCG
AACGGTACCTGAGAGATCAGCAGCTGCTGGGAATCTGGGGATGCAGCGGAAAGCTGATTTGCTGTACAAA
CGTGCCCTGGAATAGTTCATGGTCAAACAGGAATCTGAGCGAGATCTGGGACAATATGACCTGGCTGCAG
TGGGATAAGGAAATCAGTAACTACACACAGATCATCTATGGCCTGCTGGAGGAATCACAGAACCAGCAGG
AGAAAAATGAACAGGACCTGCTGGCCCTGGATCTGCCTAGCACCGGATGATGA

Figure 24B

>CH505TF.6R.SOSIP.664.v4.1_N_SORTA (HV1301189_N-SORTA)

ATGCCCATGGCAGCCTGCAGCCCTGGCCACCCTGTACCTGCTGGGCATGCTGGTGGCTAGCGTGCTGGCCGGCGG
GGGCGGGGCGGCGGGGGCGGGGCGGCGGGGGCGGGGCGCCGAGAACCTGTGGGTGACCGTCTACTATGGC
GTGCCCGTCTGGAAGGAAGCCAAAACCACACTGTTCTGCGCTAGCGACGCTAAGGCATACGAGAAAAAAGTGCACA
ATGTCTGGGCTACTCATGCATGCGTGCCTACCGATCCAAATCCCCAGGAGATGGTGCTGAAGAACGTCACAGAAAAC
TTTAATATGTGGAAGAACGACATGGTGGATCAGATGCACGAGGACGTGATCAGCCTGTGGGATCAGTCCCTGAAGCC
ATGCGTGAAACTGACTCCCCTGTGCGTCACCCTGAACTGTACTAATGCCACCGCTTCCAACAGCTCCATCATTGAGGG
GATGAAGAACTGTTCTTTCAATATCACTACCGAGCTGCGCGACAAGCGAGAAAAGAAAAATGCCCTGTTTTACAAACT
GGACATCGTGCAGCTGGATGGCAACTCTAGTCAGTATAGACTGATTAACTGCAATACAAGCGTGATCACTCAGGCAT
GTCCAAAGGTCAGTTTCGATCCTATTCCAATCCACTACTGCGCACCCGCCGGATATGCTATCCTGAAGTGTAACAACAA
GACCTTCACCGGCACTGGGCCTTGCAACAACGTGAGCACCGTCCAGTGTACACATGGCATTAAGCCAGTGGTCAGCA
CCCAGCTGCTGCTGAACGGCAGCCTGGCAGAGGGCGAAATCATTATCCGCAGCGAGAACATCACAAATAATGTGAAG
ACTATCATCGTCCACCTGAACGAGAGCGTGAAGATTGAATGCACACGGCCCAACAACAAGACCAGGACATCCATTCG
CATCGGACCTGGCCAGTGGTTCTACGCTACTGGCCAGGTCATCGGGGACATCAGAGAGGCCTATTGTAACATCAATG
AGTCAAAGTGGAATGAAACTCTGCAGAGGGTGAGCAAGAAACTGAAGGAATACTTCCCTCACAAAAACATCACCTTT
CAGCCATCAAGCGGCGGGGACCTGGAGATTACAACTCATTCTTTCAATTGCGGAGGCGAATTCTTTTACTGTAACACC
TCCTCTCTGTTTAATCGCACATATATGGCTAACAGTACTGATATGGCAAACTCTACTGAGACCAATAGTACACGAACTA
TTACCATCCATTGCCGGATCAAGCAGATTATCAACATGTGGCAGGAAGTGGGGCGGGCCATGTATGCTCCCCCTATTG
CAGGAAATATTACCTGTATCAGCAACATTACCGGCCTGCTGCTGACAAGAGACGGGGGAAAGAACAATACAGAGACT
TTTAGGCCTGGCGGGGGAAACATGAAAGATAATTGGCGCTCCGAGCTGTACAAGTATAAAGTGGTCAAGATCGAAC
CACTGGGAGTGGCACCTACCCGATGTAAACGGAGAGTGGTCGGAAGGCGCCGACGGAGAAGGGCAGTGGGAATCG
GAGCCGTCTTCCTGGGCTTTCTGGGAGCAGCTGGCAGCACAATGGGAGCAGCCTCTATGACCCTGACAGTGCAGGCT
CGAAATCTGCTGAGTGGGATCGTGCAGCAGCAGTCAAACCTGCTGCGAGCACCAGAGGCACAGCAGCATCTGCTGA
AGCTGACCGTGTGGGGCATCAAGCAGCTGCAGGCCAGAGTGCTGGCTGTCGAACGGTACCTGAGAGATCAGCAGCT
GCTGGGAATCTGGGGATGCAGCGGAAAGCTGATTTGCTGTACAAACGTGCCCTGGAATAGTTCATGGTCAAACAGG
AATCTGAGCGAGATCTGGGACAATATGACCTGGCTGCAGTGGGATAAGGAAATCAGTAACTACACACAGATCATCTA
TGGCCTGCTGGAGGAATCACAGAACCAGCAGGAGAAAAATGAACAGGACCTGCTGGCCCTGGATTGATGA

Figure 24B cont.

>CH505M5chim.6R.SOSIP.664v4.1_N_SORTA

ATGGCATGCCTGGTACCCGGAAGATATGGCTGTGCTGCTCCATGTGCTCCTGCT
GTGGGGCGGGGCGGGGGCGGCGGGGGCGGCGGGGGCGGGGGCGCCGAGAACCTGTGG
GTGACCGTGTACTACGGCGTGCCCGTGTGGAAGGAGGCCAAGACCACCCTGTTCTGCGCCTCCGAC
GCCAAGGCCTACGAGAAGAAGGTGCACAACGTGTGGGCCACCCACGCCTGCGTGCCCACCGACCCC
AACCCCCAGGAGATGGTGCTGAAGAACGTGACCGAGAACTTCAACATGTGGAAGAACGACATGGTG
GACCAGATGCACGAGGACGTGATCTCCCTGTGGGACCAGTCCCTGAAGCCCTGCGTGAAGCTGACC
CCCCTGTGCGTGACCCTGAACTGCACCAACGCCACCGCCTCCAACTCCTCCATCATCGAGGGCATG
AAGAACTGCTCCTTCAACATCACCACCGAGCTGCGCGACAAGCGCGAGAAGAAGAACGCCCTGTTC
TACAAGCTGGACATCGTGCAGCTGGACGGCAACTCCTCCCAGTACCGCCTGATCAACTGCAACACC
TCCGTGATCACCCAGGCCTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCCTGCAACAACGTG
TCCACCGTGCAGTGCACCCACGGCATCAAGCCCGTGGTGTCCACCCAGCTGCTGCTGAACGGCTCC
CTGGCCGAGGGCGAGATCATCATCCGCTCCGAGAACATCACCAAGAACGTGAAGACCATCATCGTG
CACCTGAACGAGTCCGTGAAGATCGAGTGCACCCGCCCCAACAACAAGACCCGCACCTCCATCCGC
ATCGGCCCCGGCCAGTGGTTCTACGCCACCGGCCAGGTGATCGGCGACATCCGCGAGGCCTACTGC
AACATCAACGAGTCCAAGTGGAACGAGACCCTGCAGCGCGTGTCCAAGAAGCTGAAGGAGTACTTC
CCCCACAAGAACATCACCTTCCAGCCCTCCTCCGGCGGCGACCTGGAGATCACCACCCACTCCTTC
AACTGCGGCGGCGAGTTCTTCTACTGCAACACCTCCTCCCTGTTCAACCGCACCTACATGGCCAAC
TCCACCGACATGGCCAACTCCACCGAGACCAACTCCACCCGCACCATCACCATCCACTGCCGCATC
AAGCAGATCATCAACATGTGGCAGGAGGTGGGCCGCGCCATGTACGCCCCCCCCATCGCCGGCAAC
ATCACCTGCATCTCCAACATCACCGGCCTGCTGCTGACCCGCGACGGCGGCAAGAACAACACCGAG
ACCTTCCGCCCCGGCGGCGGCAACATGAAGGACAACTGGCGCTCCGAGCTGTACAAGTACAAGGTG
GTGAAGATCGAGCCCCTGGGCGTGGCCCCCACCCGCTGCAAGCGCCGCGTGGTGGGCCGCCGCCGC
CGCCGCCGCGCCGTGGGCATCGGCGCCGTGTTCCTGGGCTTCCTGGGCGCCGCCGGCTCCACCATG
GGCGCCGCCTCCATGACCCTGACCGTGCAGGCCCGCAACCTGCTGTCCGGCATCGTGCAGCAGCAG
TCCAACCTGCTGCGCGCCCCCGAGGCCCAGCAGCACCTGCTGAAGCTGACCGTGTGGGGCATCAAG
CAGCTGCAGGCCCGCGTGCTGGCCGTGGAGCGCTACCTGCGCGACCAGCAGCTGCTGGGCATCTGG
GGCTGCTCCGGCAAGCTGATCTGCTGCACCAACGTGCCCTGGAACTCCTCCTGGTCCAACCGCAAC
CTGTCCGAGATCTGGGACAACATGACCTGGCTGCAGTGGGACAAGGAGATCTCCAACTACACCCAG
ATCATCTACGGCCTGCTGGAGGAGTCCCAGAACCAGCAGGAGAAGAACGAGCAGGACCTGCTGGCC
CTGGACTAG

Figure 24B cont.

\>CH505M5chim.6R.SOSIP.664v4.1_N_SORTA

MRVMGIQRNCQHLWRWGTMILGMLMICSAGGGGSGGGGSGGGGSAENLWVTVYYGVPVWKEAKTTLFCASD
AKAYEKEVHNVWATHACVPTDPNPQEMVLKNVTENFNMWKNDMVDQMHEDVISLWDQSLKPCVKLT
PLCVTLNCTNATASNSSIIEGMKNCSFNITTELRDKREKKNALFYKLDIVQLDGNSSQYRLINCNT
SVITQACPKVSFDPIPIHYCAPAGYAILKCNNKTFTGTGPCNNVSTVQCTHGIKPVVSTQLLLNGS
LAEGEIIIRSENITKNVKTIIVHLNESVKIECTRPNNKTRTSIRIGPGQWFYATGQVIGDIREAYC
NINESKWNETLQRVSKKLKEYFPHKNITFQPSSGGDLEITTHSFNCGGEFFYCNTSSLFNRTYMAN
STDMANSTETNSTRTITIHCRIKQIINMWQEVGRAMYAPPIAGNITCISNITGLLLTRDGGKNNTE
TFRPGGGNMKDNWRSELYKYKVVKIEPLGVAPTRCKRRVVGRRRRRAVGIGAVFLGFLGAAGSTM
GAASMTLTVQARNLLSGIVQQQSNLLRAPEAQQHLLKLTVWGIKQLQARVLAVERYLRDQQLLGIW
GCSGKLICCTNVPWNSSWSNRNLSEIWDNMTWLQWDKEISNYTQIIYGLLEESQNQQEKNEQDLLA
LD*

\>CH505M5chim.6R.SOSIP.664v4.1_C_SORTA

[highlighted sequence]GCCGAGAACCTGTGGGTGACCGTGTACTACGGCGTGCCCGTGTGGAAGGAGGCCAAGACC
ACCCTGTTCTGCGCCTCCGACGCCAAGGCCTACGAGAAGAAGGTGCACAACGTGTGGGCCACCCAC
GCCTGCGTGCCCACCGACCCCAACCCCCAGGAGATGGTGCTGAAGAACGTGACCGAGAACTTCAAC
ATGTGGAAGAACGACATGGTGGACCAGATGCACGAGGACGTGATCTCCCTGTGGGACCAGTCCCTG
AAGCCCTGCGTGAAGCTGACCCCCCTGTGCGTGACCCTGAACTGCACCAACGCCACCGCCTCCAAC
TCCTCCATCATCGAGGGCATGAAGAACTGCTCCTTCAACATCACCACCGAGCTGCGCGACAAGCGC
GAGAAGAAGAACGCCCTGTTCTACAAGCTGGACATCGTGCAGCTGGACGGCAACTCCTCCCAGTAC
CGCCTGATCAACTGCAACACCTCCGTGATCACCCAGGCCTGCCCCAAGGTGTCCTTCGACCCCATC
CCCATCCACTACTGCGCCCCCGCCGGCTACGCCATCCTGAAGTGCAACAACAAGACCTTCACCGGC
ACCGGCCCCTGCAACAACGTGTCCACCGTGCAGTGCACCCACGGCATCAAGCCCGTGGTGTCCACC
CAGCTGCTGCTGAACGGCTCCCTGGCCGAGGGCGAGATCATCATCCGCTCCGAGAACATCACCAAG
AACGTGAAGACCATCATCGTGCACCTGAACGAGTCCGTGAAGATCGAGTGCACCCGCCCCAACAAC
AAGACCCGCACCTCCATCCGCATCGGCCCCGGCCAGTGGTTCTACGCCACCGGCCAGGTGATCGGC
GACATCCGCGAGGCCTACTGCAACATCAACGAGTCCAAGTGGAACGAGACCCTGCAGCGCGTGTCC
AAGAAGCTGAAGGAGTACTTCCCCCACAAGAACATCACCTTCCAGCCCTCCTCCGGCGGCGACCTG
GAGATCACCACCCACTCCTTCAACTGCGGCGGCGAGTTCTTCTACTGCAACACCTCCTCCCTGTTC
AACCGCACCTACATGGCCAACTCCACCGACATGGCCAACTCCACCGAGACCAACTCCACCCGCACC
ATCACCATCCACTGCCGCATCAAGCAGATCATCAACATGTGGCAGGAGGTGGGCCGCGCCATGTAC
GCCCCCCCCATCGCCGGCAACATCACCTGCATCTCCAACATCACCGGCCTGCTGCTGACCCGCGAC
GGCGGCAAGAACAACACCGAGACCTTCCGCCCCGGCGGCGGCAACATGAAGGACAACTGGCGCTCC
GAGCTGTACAAGTACAAGGTGGTGAAGATCGAGCCCCTGGGCGTGGCCCCCACCCGCTGCAAGCGC
CGCGTGGTGGGCCGCCGCCGCCGCCGCGCCGTGGGCATCGGCGCCGTGTTCCTGGGCTTCCTG
GGCGCCGCCGGCTCCACCATGGGCGCCGCCTCCATGACCCTGACCGTGCAGGCCCGCAACCTGCTG
TCCGGCATCGTGCAGCAGCAGTCCAACCTGCTGCGCGCCCCCGAGGCCCAGCAGCACCTGCTGAAG
CTGACCGTGTGGGGCATCAAGCAGCTGCAGGCCCGCGTGCTGGCCGTGGAGCGCTACCTGCGCGAC
CAGCAGCTGCTGGGCATCTGGGGCTGCTCCGGCAAGCTGATCTGCTGCACCAACGTGCCCTGGAAC
TCCTCCTGGTCCAACCGCAACCTGTCCGAGATCTGGGACAACATGACCTGGCTGCAGTGGGACAAG
GAGATCTCCAACTACACCCAGATCATCTACGGCCTGCTGGAGGAGTCCCAGAACCAGCAGGAGAAG
AACGAGCAGGACCTGCTGGCCCTGGACCTGCTAGCACCGGATAG

Figure 24B cont.

>CH505M5chim.6R.SOSIP.664v4.1_C_SORTA

[REDACTED]AENLWVTVYYGVPVWKEAKTTLFCASDAKAYEKKVHNVWATH
ACVPTDPNPQEMVLKNVTENFNMWKNDMVDQMHEDVISLWDQSLKPCVKLTPLCVTLNCTNATASN
SSIIEGMKNCSFNITTELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNGSLAEGEIIIRSENITK
NVKTIIVHLNESVKIECTRPNNKTRTSIRIGPGQWFYATGQVIGDIREAYCNINESKWNETLQRVS
KKLKEYFPHKNITFQPSSGGDLEITTHSFNCGGEFFYCNTSSLFNRTYMANSTDMANSTETNSTRT
ITIHCRIKQIINMWQEVGRAMYAPPIAGNITCISNITGLLLTRDGGKNNTETFRPGGGNMKDNWRS
ELYKYKVVKIEPLGVAPTRCKRRVVGRRRRRRAVGIGAVFLGFLGAAGSTMGAASMTLTVQARNLL
SGIVQQQSNLLRAPEAQQHLLKLTVWGIKQLQARVLAVERYLRDQQLLGIWGCSGKLICCTNVPWN
SSWSNRNLSEIWDNMTWLQWDKEISNYTQIIYGLLEESQNQQEKNEQDLLALDLPSTG*

Figure 24B cont.

CH505 Ferritin constructs

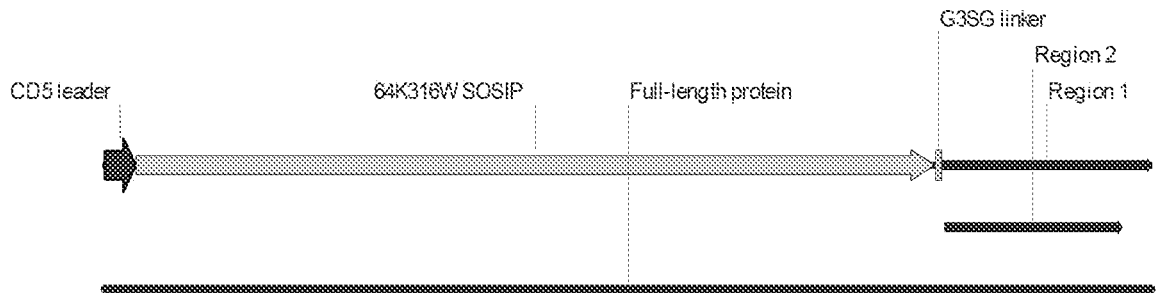

CH505TFchimv4.1-ferritin
815 aa

>CH505TFchimv4.1-ferritin (signal peptide; ferritin, glycine linker)

MPMGSLQPLA TLTLLGMLVA SVLAAENLWV TVYYGVPVWK EAKTTLFCAS
DAKAYEKKVH NVWATHACVP TDPNPQEMVL KNVTENFNMW KNDMVDQMHE
DVISLWDQSL KPCVKLTPLC VTLNCTNATA SNSSIIEGMK NCSFNITTEL
RDKREKKNAL FYKLDIVQLD GNSSQYRLIN CNTSVITQAC PKVSFDPIPI
HYCAPAGYAI LKCNNKTFTG TGPCNNVSTV QCTHGIKPVV STQLLLNGSL
AEGEIIIRSE NITNNVKTII VHLNESVKIE CTRPNNKTRT SIRIGPGQWF
YATGQVIGDI REAYCNINES KWNETLQRVS KKLKEYFPHK NITFQPSSGG
DLEITTHSFN CGGEFFYCNT SSLFNRTYMA NSTDMANSTE TNSTRTITIH
CRIKQIINMW QEVGRAMYAP PIAGNITCIS NITGLLLTRD GGKNNTETFR
PGGGNMKDNW RSELYKYKVV KIEPLGVAPT RCKRRVVGRR RRPRAVGIGA
VFLGFLGAAG STMGAASMTL TVQARNLLSG IVQQQSNLLR APEAQQHLLK
LTVWGIKQLQ ARVLAVERYL RDQQLLGIWG CSGKLICCTN VPWNSSWSNR
NLSEIWDNMT WLQWDKEISN YTQIIYGLLE ESQNQQEKNE QDLLALDGGG
SGDIIKLLNE QVNKEMNSSN LYMSMSSWCY THSLDGAGLF LFDHAAEEYE
HAKKLIIFLN ENNVPVQLTS ISAPEHKFEG LTQIFQKAYE HEQHISESIN
NIVDHAIKSK DHATFNFLQW YVAEQHEEEV LFKDILDKIE LIGNENHGLY
LADQYVKGIA KSRKS**

Figure 24G

\>CH505TFchimv4.1-ferritin(HV1301350)

```
████████GCCGAGAACCTGTGGGTGACCGTGTACTACGGCGTGCCCGTGTGGAAGGAGGCCAAGACC
ACCCTGTTCTGCGCCTCCGACGCCAAGGCCTACGAGAAGAAGGTGCACAACGTGTGGGCCACCCAC
GCCTGCGTGCCCACCGACCCCAACCCCCAGGAGATGGTGCTGAAGAACGTGACCGAGAACTTCAAC
ATGTGGAAGAACGACATGGTGGACCAGATGCACGAGGACGTGATCTCCCTGTGGGACCAGTCCCTG
AAGCCCTGCGTGAAGCTGACCCCCCTGTGCGTGACCCTGAACTGCACCAACGCCACCGCCTCCAAC
TCCTCCATCATCGAGGGCATGAAGAACTGCTCCTTCAACATCACCACCGAGCTGCGCGACAAGCGC
GAGAAGAAGAACGCCCTGTTCTACAAGCTGGACATCGTGCAGCTGGACGGCAACTCCTCCCAGTAC
CGCCTGATCAACTGCAACACCTCCGTGATCACCCAGGCCTGCCCCAAGGTGTCCTTCGACCCCATC
CCCATCCACTACTGCGCCCCCGCCGGCTACGCCATCCTGAAGTGCAACAACAAGACCTTCACCGGC
ACCGGCCCCTGCAACAACGTGTCCACCGTGCAGTGCACCCACGGCATCAAGCCCGTGGTGTCCACC
CAGCTGCTGCTGAACGGCTCCCTGGCCGAGGGCGAGATCATCATCCGCTCCGAGAACATCACCAAC
AACGTGAAGACCATCATCGTGCACCTGAACGAGTCCGTGAAGATCGAGTGCACCCGCCCCAACAAC
AAGACCCGCACCTCCATCCGCATCGGCCCCGGCCAGTGGTTCTACGCCACCGGCCAGGTGATCGGC
GACATCCGCGAGGCCTACTGCAACATCAACGAGTCCAAGTGGAACGAGACCCTGCAGCGCGTGTCC
AAGAAGCTGAAGGAGTACTTCCCCCACAAGAACATCACCTTCCAGCCCTCCTCCGGCGGCGACCTG
GAGATCACCACCCACTCCTTCAACTGCGGCGGCGAGTTCTTCTACTGCAACACCTCCTCCCTGTTC
AACCGCACCTACATGGCCAACTCCACCGACATGGCCAACTCCACCGAGACCAACTCCACCCGCACC
ATCACCATCCACTGCCGCATCAAGCAGATCATCAACATGTGGCAGGAGGTGGGCCGCGCCATGTAC
GCCCCCCCCATCGCCGGCAACATCACCTGCATCTCCAACATCACCGGCCTGCTGCTGACCCGCGAC
GGCGGCAAGAACAACACCGAGACCTTCCGCCCCGGCGGCGGCAACATGAAGGACAACTGGCGCTCC
GAGCTGTACAAGTACAAGGTGGTGAAGATCGAGCCCCTGGGCGTGGCCCCCACCCGCTGCAAGCGC
CGCGTGGTGGGCCGCCGCCGCCGCCGCCGCCGTGGGCATCGGCGCCGTGTTCCTGGGCTTCCTG
GGCGCCGCCGGCTCCACCATGGGCGCCGCCTCCATGACCCTGACCGTGCAGGCCCGCAACCTGCTG
TCCGGCATCGTGCAGCAGCAGTCCAACCTGCTGCGCGCCCCCGAGGCCCAGCAGCACCTGCTGAAG
CTGACCGTGTGGGGCATCAAGCAGCTGCAGGCCCGCGTGCTGGCCGTGGAGCGCTACCTGCGCGAC
CAGCAGCTGCTGGGCATCTGGGGCTGCTCCGGCAAGCTGATCTGCTGCACCAACGTGCCCTGGAAC
TCCTCCTGGTCCAACCGCAACCTGTCCGAGATCTGGGACAACATGACCTGGCTGCAGTGGGACAAG
GAGATCTCCAACTACACCCAGATCATCTACGGCCTGCTGGAGGAGTCCCAGAACCAGCAGGAGAAG
AACGAGCAGGACCTGCTGGCCCTGGACGGCGGCGGCTCCGGCGACATCATCAAGCTGCTGAACGAG
CAGGTGAACAAGGAGATGAACTCCTCCAACCTGTACATGTCCATGTCCTCCTGGTGCTACACCCAC
TCCCTGGACGGCGCCGGCCTGTTCCTGTTCGACCACGCCGCCGAGGAGTACGAGCACGCCAAGAAG
CTGATCATCTTCCTGAACGAGAACAACGTGCCCGTGCAGCTGACCTCCATCTCCGCCCCCGAGCAC
AAGTTCGAGGGCCTGACCCAGATCTTCCAGAAGGCCTACGAGCACGAGCAGCACATCTCCGAGTCC
ATCAACAACATCGTGGACCACGCCATCAAGTCCAAGGACCACGCCACCTTCAACTTCCTGCAGTGG
TACGTGGCCGAGCAGCACGAGGAGGAGGTGCTGTTCAAGGACATCCTGGACAAGATCGAGCTGATC
GGCAACGAGAACCACGGCCTGTACCTGGCCGACCAGTACGTGAAGGGCATCGCCAAGTCCCGCAAG
TCCTGATAA
```

Figure 24G cont.

\>CH505M5chimv4.1-ferritin (signal peptide; ferritin, glycine linker)

MPMGSLQPLATLYLLGMLVASVLAAENLWVTVYYGVPVWKEAKTTLFCASDAKAYEKKVH
NVWATHACVPTDPNPQEMVLKNVTENFNMWKNDMVDQMHEDVISLWDQSLKPCVKLTPLC
VTLNCTNATASNSSIIEGMKNCSFNITTELRDKREKKNALFYKLDIVQLDGNSSQYRLIN
CNTSVITQACPKVSFDPIPIHYCAPAGYAILKCNNKTFTGTGPCNNVSTVQCTHGIKPVV
STQLLLNGSLAEGEIIIRSENITKNVKTIIVHLNESVKIECTRPNNKTRTSIRIGPGQWF
YATGQVIGDIREAYCNINESKWNETLQRVSKKLKEYFPHKNITFQPSSGGDLEITTHSFN
CGGEFFYCNTSSLFNRTYMANSTDMANSTETNSTRTITIHCRIKQIINMWQEVGRAMYAP
PIAGNITCISNITGLLLTRDGGKNNTETFRPGGGNMKDNWRSELYKYKVVKIEPLGVAPT
RCKRRVGRRRRRAVGIGAVFLGFLGAAGSTMGAASMTLTVQARNLLSGIVQQQSNLLR
APEAQQHLLKLTVWGIKQLQARVLAVERYLRDQQLLGIWGCSGKLICCTNVPWNSSWSNR
NLSEIWDNMTWLQWDKEISNYTQIIYGLLEESQNQQEKNEQDLLALDGGGSGDIIKLLNE
QVNKEMNSSNLYMSMSSWCYTHSLDGAGLFLFDHAAEEYEHAKKLIIFLNENNVPVQLTS
ISAPEHKFEGLTQIFQKAYEHEQHISESINNIVDHAIKSKDHATFNFLQWYVAEQHEEEV
LFKDILDKIELIGNENHGLYLADQYVKGIAKSRKS**

Figure 24G cont.

>CH505M5chimv4.1-ferritin(HV1301349)

```
CTGGCGCCGAGAACCTGTGGGTGACCGTGTACTACGGCGTGCCCGTGTGGAAGGAGGCCAAGACC
ACCCTGTTCTGCGCCTCCGACGCCAAGGCCTACGAGAAGAAGGTGCACAACGTGTGGGCCACCCAC
GCCTGCGTGCCCACCGACCCCAACCCCCAGGAGATGGTGCTGAAGAACGTGACCGAGAACTTCAAC
ATGTGGAAGAACGACATGGTGGACCAGATGCACGAGGACGTGATCTCCCTGTGGGACCAGTCCCTG
AAGCCCTGCGTGAAGCTGACCCCCCTGTGCGTGACCCTGAACTGCACCAACGCCACCGCCTCCAAC
TCCTCCATCATCGAGGGCATGAAGAACTGCTCCTTCAACATCACCACCGAGCTGCGCGACAAGCGC
GAGAAGAAGAACGCCCTGTTCTACAAGCTGGACATCGTGCAGCTGGACGGCAACTCCTCCCAGTAC
CGCCTGATCAACTGCAACACCTCCGTGATCACCCAGGCCTGCCCCAAGGTGTCCTTCGACCCCATC
CCCATCCACTACTGCGCCCCCGCCGGCTACGCCATCCTGAAGTGCAACAACAAGACCTTCACCGGC
ACCGGCCCCTGCAACAACGTGTCCACCGTGCAGTGCACCCACGGCATCAAGCCCGTGGTGTCCACC
CAGCTGCTGCTGAACGGCTCCCTGGCCGAGGGCGAGATCATCATCCGCTCCGAGAACATCACCAAG
AACGTGAAGACCATCATCGTGCACCTGAACGAGTCCGTGAAGATCGAGTGCACCCGCCCCAACAAC
AAGACCCGCACCTCCATCCGCATCGGCCCCGGCCAGTGGTTCTACGCCACCGGCCAGGTGATCGGC
GACATCCGCGAGGCCTACTGCAACATCAACGAGTCCAAGTGGAACGAGACCCTGCAGCGCGTGTCC
AAGAAGCTGAAGGAGTACTTCCCCCACAAGAACATCACCTTCCAGCCCTCCTCCGGCGGCGACCTG
GAGATCACCACCCACTCCTTCAACTGCGGCGGCGAGTTCTTCTACTGCAACACCTCCTCCCTGTTC
AACCGCACCTACATGGCCAACTCCACCGACATGGCCAACTCCACCGAGACCAACTCCACCCGCACC
ATCACCATCCACTGCCGCATCAAGCAGATCATCAACATGTGGCAGGAGGTGGGCCGCGCCATGTAC
GCCCCCCCCATCGCCGGCAACATCACCTGCATCTCCAACATCACCGGCCTGCTGCTGACCCGCGAC
GGCGGCAAGAACAACACCGAGACCTTCCGCCCCGGCGGCGGCAACATGAAGGACAACTGGCGCTCC
GAGCTGTACAAGTACAAGGTGGTGAAGATCGAGCCCCTGGGCGTGGCCCCCACCCGCTGCAAGCGC
CGCGTGGTGGGCCGCCGCCGCCGCCGCGCCGTGGGCATCGGCGCCGTGTTCCTGGGCTTCCTG
GGCGCCGCCGGCTCCACCATGGGCGCCGCCTCCATGACCCTGACCGTGCAGGCCCGCAACCTGCTG
TCCGGCATCGTGCAGCAGCAGTCCAACCTGCTGCGCGCCCCCGAGGCCCAGCAGCACCTGCTGAAG
CTGACCGTGTGGGGCATCAAGCAGCTGCAGGCCCGCGTGCTGGCCGTGGAGCGCTACCTGCGCGAC
CAGCAGCTGCTGGGCATCTGGGGCTGCTCCGGCAAGCTGATCTGCTGCACCAACGTGCCCTGGAAC
TCCTCCTGGTCCAACCGCAACCTGTCCGAGATCTGGGACAACATGACCTGGCTGCAGTGGGACAAG
GAGATCTCCAACTACACCCAGATCATCTACGGCCTGCTGGAGGAGTCCCAGAACCAGCAGGAGAAG
AACGAGCAGGACCTGCTGGCCCTGGACGGCGGCGGCTCCGGCGACATCATCAAGCTGCTGAACGAG
CAGGTGAACAAGGAGATGAACTCCTCCAACCTGTACATGTCCATGTCCTCCTGGTGCTACACCCAC
TCCCTGGACGGCGCCGGCCTGTTCCTGTTCGACCACGCCGCCGAGGAGTACGAGCACGCCAAGAAG
CTGATCATCTTCCTGAACGAGAACAACGTGCCCGTGCAGCTGACCTCCATCTCCGCCCCCGAGCAC
AAGTTCGAGGGCCTGACCCAGATCTTCCAGAAGGCCTACGAGCACGAGCAGCACATCTCCGAGTCC
ATCAACAACATCGTGGACCACGCCATCAAGTCCAAGGACCACGCCACCTTCAACTTCCTGCAGTGG
TACGTGGCCGAGCAGCACGAGGAGGAGGTGCTGTTCAAGGACATCCTGGACAAGATCGAGCTGATC
GGCAACGAGAACCACGGCCTGTACCTGGCCGACCAGTACGTGAAGGGCATCGCCAAGTCCCGCAAG
TCCTAGTAA
```

Figure 24G cont.

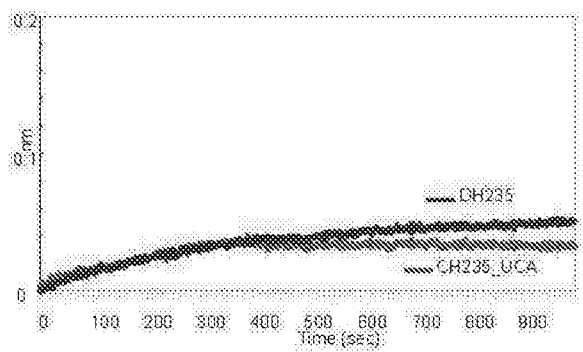 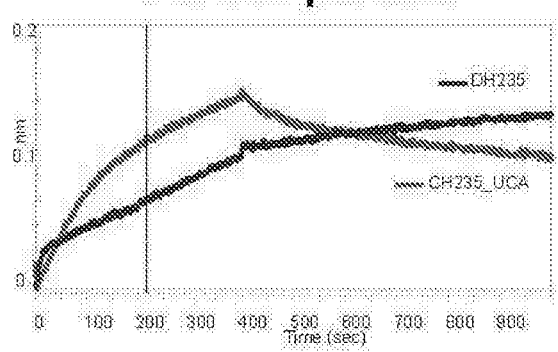
Figure 24I
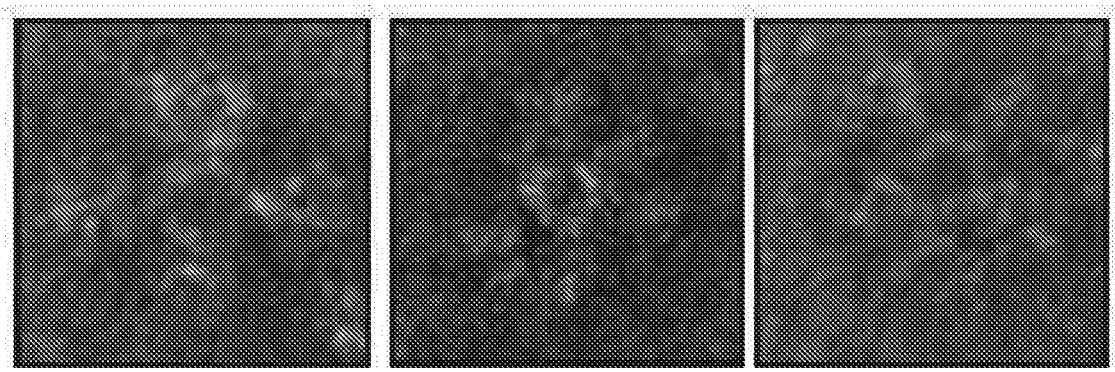
Figure 24J

Group 1 (N=3): CH505 gp140-CD40 IgG4
Group 2 (N=4): CH505 gp140C

Identical binding patterns were observed for weeks 53, 78, and 100 gp140

| 6207 Plasma neutralization titer (ID50; reciprocal dilution) | | | |
|---|---|---|---|
| Virus | Tier | Study week | |
| | | 30 | 36 |
| SVA-MLV | NA | <20 | <20 |
| 398-F1-F6_20 | Tier 2 | <20 | 21 |
| 25710-2.43 | Tier 2 | <20 | 23 |
| CNE8 | Tier 2 | <20* | 30 |
| TRO.11 | Tier 2 | 108 | 97 |
| X2278_C2_B6 | Tier 2 | <20 | 29 |
| BJOX002000.03.2 | Tier 2 | <20 | 21 |
| X1632_S2_B10 | Tier 2 | <20* | <20* |
| Ce1176_A3 | Tier 2 | <20* | 27 |
| 246-F3_C10_2 | Tier 2 | <20 | <20* |
| CH119.10 | Tier 2 | <20* | 21 |
| Ce703010217_B6 | Tier 2 | <20 | <20 |
| CNE55 | Tier 2 | 84 | 91 |

*Percent neutralization >40%

9/12 (75%) heterologous tier 2 viruses were neutralized

Titer Scale

| <20 | 20-90 | 91-499 | 500-1000 | >1000 |
|---|---|---|---|---|

|       | 97 | 275 | 278 | 279 | 281 | 471 | V5length |
|-------|----|-----|-----|-----|-----|-----|----------|
| M5    | K  | E   | T   | K   | V   | G   | 8        |
| 30.25 | K  | E   | T   | N   | A   | G   | 10       |
| 53.25 | E  | E   | T   | D   | G   | G   | 11       |
| 53.29 | K  | E   | T   | N   | A   | E   | 11       |

Figure 38

|  | Mab (Lot #) | |  |
| --- | --- | --- | --- |
|  | DH235UCAtkLL_v3_4A (48 EML) | DH235UCAtkLL_v3_4A (170712 PPF) |  |
| CH0505TF.M5/293T | >50* | >50 |  |
| CH0505TF.M5/GnTI- | 0.064 | 2.7 | 42x |
| CH0505TF.M5.G458Y/293T | 0.062 | 5.4 | 87x |
| CH0505TF.M5.G458Y/GnTI- | 0.01 | 0.03 |  |

*DH235UCA LL has IC50 = 1.8 µg/ml

Figure 43

| Chim.6R.SOSIP.664 v4.1 | CH235 UCA Binding Kd (nM) | CH235 UCA Neutralization IC50 (μg/ml) |
|---|---|---|
| CH0505.N279K/293F | 231 | >50 |
| CH0505.N279K.G458Y/293F | 89 | 8.5 |
| CH0505.N279K/GnTI- | 35 | 2.8 |
| *CH0505.N279K.G458Y/GnTI- | 6 | 0.03 |

\>pCH235HUCA_4A

CAGGTGCAGCTGGTGCAGTCTGGGGCTGAGGTGAAGAAGCCTGGGGCCTCAGTGAAGGTTTCCTGCAAGGCATC
TGGATACACCTTCACCAGCTACTATATGCACTGGGTGCGACAGGCCCCTGGACAAGGGCTTGAGTGGATGGGAAT
AATCAACCCTAGTGGTGGTAGCACAAGCTACGCACAGAAGTTCCAGGGCAGAGTCACCATGACCAGGGACACGTC
CACGAGCACAGTCTACATGGAGCTGAGCAGCCTGAGATCTGAGGACACGGCCGTGTATTACTGTGCGAGAGATGT
GGCAACGGAGGGGAGCTTACTCCACTTTGACTACTGGGGCCAGGGAACCCTGGTCACCGTCTCCTCAGCGTCGAC

\>pDH235VH_UCAtk_v2_4A

CAGGTGCAGCTGGTGCAGTCTGGGGCTGAGGTGAAGAAGCCTGGGGCCTCAGTGAAGGTTTCCTGCAAGGCATC
TGGATACACCTTCACCAGCTACTATATGCACTGGGTGCGACAGGCCCCTGGACAAGGGCTTGAGTGGATGGGAAT
AATCAACCCTAGTGGTGGTAGCACAAGCTACGCACAGAAGTTCCAGGGCAGAGTCACCATGACCAGGGACACGTC
CACGAGCACAGTCTACATGGAGCTGAGCAGCCTGAGATCTGAGGACACGGCCGTGTATTACTGTGCGAGAGACG
TGGGAACGGAGGGGAGTTTACTCCACTTTGACTACTGGGGCCAGGGAACCCTGGTCACCGTCTCCTCAGCGTCGA
C

\>pCH235KUCA

GAAATAGTGATGACGCAGTCTCCAGCCACCCTGTCTGTGTCTCCAGGGGAAAGAGCCACCCTCTCCTGCAGGGCC
AGTCAGAGTGTTAGCAGCAACTTAGCCTGGTACCAGCAGAAACCTGGCCAGGCTCCCAGGCTCCTCATCTATGGT
GCATCCACCAGGGCCACTGGTATCCCAGCCAGGTTCAGTGGCAGTGGGTCTGGGACAGAGTTCACTCTCACCATC
AGCAGCCTGCAGTCTGAAGATTTTGCAGTTTATTACTGTCAGCAGTATAATAACTGGTGGACGTTCGGCCAAGGGA
CCAAGGTGGAAATCAAACGAACTGTGGCTGCACCATCTGTCTTCATCTTCCCGCCATCTGATGAGCAATTG

\>pDH235VK_UCAtk gaaattgtgtTGACGCAGTCTCCAGCCACCCTGTCTGTGTCTCCAGGGGAAAGAGCCACCCTCTCCTGCAGGGCCAGT
CAGAGTGTTAGCAGCAACTTAGCCTGGTACCAGCAGAAACCTGGCCAGGCTCCCAGGCTCCTCATCTATGGTGCAT
CCACCAGGGCCACTGGTATCCCAGCCAGGTTCAGTGGCAGTGGGTCTGGGACAGAGTTCACTCTCACCATCAGCA
GCCTGCAGTCTGAAGATTTTGCAGTTTATTACTGTCAGCAGTATAATAACTGGTGGACGTTCGGCCAAGGGACCAA
GGTGGAAATCAAACGAACTGTGGCTGCACCATCTGTCTTCATCTTCCCGCCATCTGATGAGCAATTG

Figure 59A

Translate results

>CH235HUCA_4A

QVQLVQSGAEVKKPGASVKVSCKASGYTFTSYYMHWVRQAPGQGLEWMGIINPSGGSTSYAQKFQGRVTMTRDTST
STVYMELSSLRSEDTAVYYCARDVATEGSLLHFDYWGQGTLVTVSS

>DH235VH_UCAtk_v2_4A

QVQLVQSGAEVKKPGASVKVSCKASGYTFTSYYMHWVRQAPGQGLEWMGIINPSGGSTSYAQKFQGRVTMTRDTST
STVYMELSSLRSEDTAVYYCARDVGTEGSLLHFDYWGQGTLVTVSS

>CH235KUCA

EIVMTQSPATLSVSPGERATLSCRASQSVSSNLAWYQQKPGQAPRLLIYGASTRATGIPARFSGSGSGTEFTLTISSLQSE
DFAVYYCQQYNNWWTFGQGTKVEIK

>DH235VK_UCAtk

EIVLTQSPATLSVSPGERATLSCRASQSVSSNLAWYQQKPGQAPRLLIYGASTRATGIPARFSGSGSGTEFTLTISSLQSED
FAVYYCQQYNNWWTFGQGTKVEIK

Figure 59B

| | HV# | Plasmid ID |
|---|---|---|
| 1 | HV1301288_G458Y | CH505M5chim.6R.SOSIP.664v4.1_G458Y |
| 2 | HV1301289_G458Y | CH505M11chim.6R.SOSIP.664v4.1_G458Y |
| 3 | HV1300531_v2_G458Y | CH505.M5D8gp120_G458Y |
| 4 | HV1301349_G458Y | CH505M5chimv4.1-ferritin_G458Y |
| 5 | HV1301582 | CH505M5chim.6R.DS.SOSIP.664v4.1_G458Y |
| 6 | HV1301596_G458Y | CH505M5chim.6R.SOSIP.664v5.2.8_G458Y |
| 7 | HV1301597_G458Y_avi.2 | CH505M5chim.6R.SOSIP.664v4.1_G458Y_avi.2 |
| 8 | HV1301606_G458Y | CH505M5chim.6R.SOSIP.v4.1.1_G458Y (aka CH505M5chim.6R.SOSIP.664v4.1_G458Y_A73C_A561C) |

AMINO ACID SEQUENCES

>HV1301288_G458Y (CH505M5chim.6R.SOSIP.664v4.1_G458Y)

MPMGSLQPLATLYLLGMLVASVLAAENLWVTVYYGVPVWKEAKTTLFCASDAKAYEKKVHNVWATHACVPTDPNPQEMVLKNVTENF
NMWKNDMVDQMHEDVISLWDQSLKPCVKLTPLCVTLNCTNATASNSSIIEGMKNCSFNITTELRDKREKKNALFYKLDIVQLDGNSSQYR
LINCNTSVITQACPKVSFDPIPIHYCAPAGYAILKCNNKTFTGTGPCNNVSTVQCTHGIKPVVSTQLLLNGSLAEGEIIRSENITKNVKTIIVHLN
ESVKIECTRPNNKTRTSIRIGPGQWFYATGQVIGDIREAYCNINESKWNETLQRVSKKLKEYFPHKNITFQPSSGGDLEITTHSFNCGGEFFYC
NTSSLFNRTYMANSTDMANSTETNSTRTITIHCRIKQIINMWQEVGRAMYAPPIAGNITCISNITGLLLTRDYGKNNTETFRPGGGNMKDN
WRSELYKYKVVKIEPLGVAPTRCKRRVVGRRRRRRAVGIGAVFLGFLGAAGSTMGAASMTLTVQARNLLSGIVQQQSNLLRAPEAQQHLL
KLTVWGIKQLQARVLAVERYLRDQQLLGIWGCSGKLICCTNVPWNSSWSNRNLSEIWDNMTWLQWDKEISNYTQIIYGLLEESQNQQEK
NEQDLLALD*

>HV1301289_G458Y

MPMGSLQPLATLYLLGMLVASVLAAENLWVTVYYGVPVWKEAKTTLFCASDAKAYEKKVHNVWATHACVPTDPNPQEMVLKNVTENF
NMWKNDMVDQMHEDVISLWDQSLKPCVKLTPLCVTLNCTNATASNSSIIEGMKNCSFNITTELRDKREKKNALFYKLDIVQLDGNSSQYR
LINCNTSVITQACPKVSFDPIPIHYCAPAGYAILKCNNKTFTGTGPCNNVSTVQCTHGIKPVVSTQLLLNGSLAEGEIIRSENITDNGKTIIVHL
NESVKIECTRPNNKTRTSIRIGPGQWFYATGQVIGDIREAYCNINESKWNETLQRVSKKLKEYFPHKNITFQPSSGGDLEITTHSFNCGGEFFY
CNTSSLFNRTYMANSTDMANSTETNSTRTITIHCRIKQIINMWQEVGRAMYAPPIAGNITCISNITGLLLTRDYGKNNTETFRPGGGNMKD
NWRSELYKYKVVKIEPLGVAPTRCKRRVVGRRRRRRAVGIGAVFLGFLGAAGSTMGAASMTLTVQARNLLSGIVQQQSNLLRAPEAQQHL
LKLTVWGIKQLQARVLAVERYLRDQQLLGIWGCSGKLICCTNVPWNSSWSNRNLSEIWDNMTWLQWDKEISNYTQIIYGLLEESQNQQE
KNEQDLLALD*

MRVMGIQRNYPQWWIWSMLGFWMLMICNGVPVWKEAKTTLFCASDAKAYEKEVHNVWATHACVPTDPNPQEMVLKNVTENFNM
WKNDMVDQMHEDVISLWDQSLKPCVKLTPLCVTLNCTNATASNSSIIEGMKNCSFNITTELRDKREKKNALFYKLDIVQLDGNSSQYRLIN
CNTSVITQACPKVSFDPIPIHYCAPAGYAILKCNNKTFTGTGPCNNVSTVQCTHGIKPVVSTQLLLNGSLAEGEIIRSENITKNVKTIIVHLNES
VKIECTRPNNKTRTSIRIGPGQAFYATGQVIGDIREAYCNINESKWNETLQRVSKKLKEYFPHKNITFQPSSGGDLEITTHSFNCGGEFFYCNT
SSLFNRTYMANSTDMANSTETNSTRTITIHCRIKQIINMWQEVGRAMYAPPIAGNITCISNITGLLLTRDYGKNNTETFRPGGGNMKDNW
RSELYKYKVVEVKPLGVAPTNARERVVEREKE**

>HV1301349_G458Y

MPMGSLQPLATLYLLGMLVASVLAAENLWVTVYYGVPVWKEAKTTLFCASDAKAYEKKVHNVWATHACVPTDPNPQEMVLKNVTENF
NMWKNDMVDQMHEDVISLWDQSLKPCVKLTPLCVTLNCTNATASNSSIIEGMKNCSFNITTELRDKREKKNALFYKLDIVQLDGNSSQYR
LINCNTSVITQACPKVSFDPIPIHYCAPAGYAILKCNNKTFTGTGPCNNVSTVQCTHGIKPVVSTQLLLNGSLAEGEIIRSENITKNVKTIIVHLN
ESVKIECTRPNNKTRTSIRIGPGQWFYATGQVIGDIREAYCNINESKWNETLQRVSKKLKEYFPHKNITFQPSSGGDLEITTHSFNCGGEFFYC
NTSSLFNRTYMANSTDMANSTETNSTRTITIHCRIKQIINMWQEVGRAMYAPPIAGNITCISNITGLLLTRDYGKNNTETFRPGGGNMKDN
WRSELYKYKVVKIEPLGVAPTRCKRRVVGRRRRRRAVGIGAVFLGFLGAAGSTMGAASMTLTVQARNLLSGIVQQQSNLLRAPEAQQHLL
KLTVWGIKQLQARVLAVERYLRDQQLLGIWGCSGKLICCTNVPWNSSWSNRNLSEIWDNMTWLQWDKEISNYTQIIYGLLEESQNQQEK
NEQDLLALDGGGSGDIIKLLNEQVNKEMNSSNLYMSMSSWCYTHSLDGAGLFLFDHAAEEYEHAKKLIIFLNENNVPVQLTSISAPEHKFEG
LTQIFQKAYEHEQHISESINNIVDHAIKSKDHATFNFLQWYVAEQHEEEVLFKDILDKIELIGNENHGLYLADQYVKGIAKSRKS**

>HV1301582

MPMGSLQPLATLYLLGMLVASVLAAENLWVTVYYGVPVWKEAKTTLFCASDAKAYEKKVHNVWATHACVPTDPNPQEMVLKNVTENF
NMWKNDMVDQMHEDVISLWDQSLKPCVKLTPLCVTLNCTNATASNSSIIEGMKNCSFNITTELRDKREKKNALFYKLDIVQLDGNSSQYR
LINCNTSVCTQACPKVSFDPIPIHYCAPAGYAILKCNNKTFTGTGPCNNVSTVQCTHGIKPVVSTQLLLNGSLAEGEIIRSENITKNVKTIIVHL
NESVKIECTRPNNKTRTSIRIGPGQWFYATGQVIGDIREAYCNINESKWNETLQRVSKKLKEYFPHKNITFQPSSGGDLEITTHSFNCGGEFFY
CNTSSLFNRTYMANSTDMANSTETNSTRTITIHCRIKQIINMWQEVGRCMYAPPIAGNITCISNITGLLLTRDYGKNNTETFRPGGGNMKD
NWRSELYKYKVVKIEPLGVAPTRCKRRVVGRRRRRRAVGIGAVFLGFLGAAGSTMGAASMTLTVQARNLLSGIVQQQSNLLRAPEAQQHL
LKLTVWGIKQLQARVLAVERYLRDQQLLGIWGCSGKLICCTNVPWNSSWSNRNLSEIWDNMTWLQWDKEISNYTQIIYGLLEESQNQQE
KNEQDLLALD*

>HV1301596_G458Y

MPMGSLQPLATLYLLGMLVASVLAAENLWVTVYYGVPVWKDAETTLFCASDAKAYEKKKRNVWATHCCVPTDPNPQEMVLKNVTENF
NMWKNDMVDQMHTDVISLWDQSLKPCVKLTPLCVTLNCTNATASNSSIIEGMKNCSFNITTELRDKREKKNALFYKLDIVQLDGNSSQYR
LINCNTSVITQACPKVSFDPIPIHYCAPAGYAILKCNNKTFTGTGPCNNVSTVQCTHGIKPVVSTQLLLNGSLAEGEIIRSENITNKVKTIIVHLK
ESVKIECTRPNNKTRTSIRIGPGQWFYATGQVIGDIREAYCNINESKWNETLQRVSKKLKEYFPHKNITFQPSSGGDLEITTHSFNCGGEFFYC
NTSSLFNRTYMANSTDMANSTETNSTRTITIHCRIKQIINMWQRVGQAMYAPPIAGNITCISNITGLLLTRDGYKNNTETFRPGGGNMKD
NWRSELYKYKVVKIEPLGVAPTRCKRRVVGRRRRRRAVGIGAVFLGFLGAAGSTMGAASMTLTVQARNLLSGIVQQQSNLLRAPECQQHL
LKLTVWGIKQLQARVLAVERYLRDQQLLGIWGCSGKLICCTNVPWNSSWSNRNLSEIWDNMTWLQWDKEISNYTQIIYGLLEESQNQQE
KNEQDLLALD**

Figure 59C continued

\>HV1301597_G458Y_avi.2

MPMGSLQPLATLYLLGMLVASVLAAENLWVTVYYGVPVWKEAKTTLFCASDAKAYEKKVHNVWATHACVPTDPNPQEMVLKNVTENF
NMWKNDMVDQMHEDVISLWDQSLKPCVKLTPLCVTLNCTNATASNSSIIEGMKNCSFNITTELRDKREKKNALFYKLDIVQLDGNSSQYR
LINCNTSVITQACPKVSFDPIPIHYCAPAGYAILKCNNKTFTGTGPCNNVSTVQCTHGIKPVVSTQLLLNGSLAEGEIIRSENITNNVKTIIVHL
NESVKIEGTRPNNKTRTSIRIGPGQWFYATGQVIGDIREAYCNINESKWNETLQRVSKKLKEYFPHKNITFQPSSGGDLEITTHSFNCGGEFF
YCNTSSLFNRTYMANSTDMANSTETNSTRTITIHCRIKQIINMWQEVGRAMYAPPIAGNITCISNITGLLLTRDYGKNNTETFRPGGGNMK
DNWRSELYKYKVVKIEPLGVAPTRCKRRVVGRRRRRRAVGIGAVFLGFLGAAGSTMGAASMTLTVQARNLLSGIVQQQSNLLRAPEAQQ
HLLKLTVWGIKQLQARVLAVERYLRDQQLLGIWGCSGKLICCTNVPWNSSWSNRNLSEIWDNMTWLQWDKEISNYTQIIYGLLEESQNQ
QEKNEQDLLALDGGGGSGLNDIFEAQKIEWHE**

\>HV1301606_G458Y

MPMGSLQPLATLYLLGMLVASVLAAENLWVTVYYGVPVWKEAKTTLFCASDAKAYEKKVHNVWATHCCVPTDPNPQEMVLKNVTENF
NMWKNDMVDQMHEDVISLWDQSLKPCVKLTPLCVTLNCTNATASNSSIIEGMKNCSFNITTELRDKREKKNALFYKLDIVQLDGNSSQYR
LINCNTSVITQACPKVSFDPIPIHYCAPAGYAILKCNNKTFTGTGPCNNVSTVQCTHGIKPVVSTQLLLNGSLAEGEIIRSENITKNVKTIIVHLN
ESVKIECTRPNNKTRTSIRIGPGQWFYATGQVIGDIREAYCNINESKWNETLQRVSKKLKEYFPHKNITFQPSSGGDLEITTHSFNCGGEFFYC
NTSSLFNRTYMANSTDMANSTETNSTRTITIHCRIKQIINMWQEVGRAMYAPPIAGNITCISNITGLLLTRDYGKNNTETFRPGGGNMKDN
WRSELYKYKVVKIEPLGVAPTRCKRRVVGRRRRRRAVGIGAVFLGFLGAAGSTMGAASMTLTVQARNLLSGIVQQQSNLLRAPECQQHLL
KLTVWGIKQLQARVLAVERYLRDQQLLGIWGCSGKLICCTNVPWNSSWSNRNLSEIWDNMTWLQWDKEISNYTQIIYGLLEESQNQQEK
NEQDLLALD*

Figure 59C continued

NUCLEOTIDE SEQUENCES

>HV1301288_G458Y

GTCGACAAGCTTcccgggccaccATGCCCATGGGCTCCCTGCAGCCCCTGGCCACCCTGTACCTGCTGGGCATGCTGGTGGCCTCCGTGC
TGGCCGCCGAGAACCTGTGGGTGACCGTGTACTACGGCGTGCCCGTGTGGAAGGAGGCCAAGACCACCCTGTTCTGCGCCTCCGAC
GCCAAGGCCTACGAGAAGAAGGTGCACAACGTGTGGGCCACCCACGCCTGCGTGCCCACCGACCCCAACCCCAGGAGATGGTGCT
GAAGAACGTGACCGAGAACTTCAACATGTGGAAGAACGACATGGTGGACCAGATGCACGAGGACGTGATCTCCCTGTGGGACCAGT
CCCTGAAGCCCTGCGTGAAGCTGACCCCCCTGTGCGTGACCCTGAACTGCACCAACGCCACCGCCTCCAACTCCTCCATCATCGAGGG
CATGAAGAACTGCTCCTTCAACATCACCACCGAGCTGCGCGACAAGCGCGAGAAGAAGAACGCCCTGTTCTACAAGCTGGACATCGT
GCAGCTGGACGGCAACTCCTCCCAGTACCGCCTGATCAACTGCAACACCTCCGTGATCACCCAGGCCTGCCCCAAGGTGTCCTTCGAC
CCCATCCCCATCCACTACTGCGCCCCCGCCGGCTACGCCATCCTGAAGTGCAACAACAAGACCTTCACCGGCACCGGCCCCTGCAACA
ACGTGTCCACCGTGCAGTGCACCCACGGCATCAAGCCCGTGGTGTCCACCCAGCTGCTGCTGAACGGCTCCCTGGCCGAGGGCGAG
ATCATCATCCGCTCCGAGAACATCACCAAGAACGTGAAGACCATCATCGTGCACCTGAACGAGTCCGTGAAGATCGAGTGCACCCGC
CCCAACAACAAGACCCGCACCTCCATCCGCATCGGCCCCGGCCAGTGGTTCTACGCCACCGGCCAGGTGATCGGCGACATCCGCGAG
GCCTACTGCAACATCAACGAGTCCAAGTGGAACGAGACCCTGCAGCGCGTGTCCAAGAAGCTGAAGGAGTACTTCCCCCACAAGAA
CATCACCTTCCAGCCCTCCTCCGGCGGCGACCTGGAGATCACCACCCACTCCTTCAACTGCGGCGGCGAGTTCTTCTACTGCAACACCT
CCTCCCTGTTCAACCGCACCTACATGGCCAACTCCACCGACATGGCCAACTCCACCGAGACCAACTCCACCCGCACCATCACCATCCAC
TGCCGCATCAAGCAGATCATCAACATGTGGCAGGAGGTGGGCCGCGCCATGTACGCCCCCCCCATCGCCGGCAACATCACCTGCATC
TCCAACATCACCGGCCTGCTGCTGACCCGCGACtaCGGCAAGAACAACACCGAGACCTTCCGCCCCGGCGGCGGCAACATGAAGGAC
AACTGGCGCTCCGAGCTGTACAAGTACAAGGTGGTGAAGATCGAGCCCCTGGGCGTGGCCCCCACCCGCTGCAAGCGCCGCGTGGT
GGGCCGCCGCCGCCGCCGCCGCCGTGGGCATCGGCGCCGTGTTCCTGGGCTTCCTGGGCGCCGCCGGCTCCACCATGGGCGCCG
CCTCCATGACCCTGACCGTGCAGGCCCGCAACCTGCTGTCCGGCATCGTGCAGCAGCAGTCCAACCTGCTGCGCGCCCCCGAGGCC
AGCAGCACCTGCTGAAGCTGACCGTGTGGGGCATCAAGCAGCTGCAGGCCCGCGTGCTGGCCGTGGAGCGCTACCTGCGCGACCAG
CAGCTGCTGGGCATCTGGGGCTGCTCCGGCAAGCTGATCTGCTGCACCAACGTGCCCTGGAACTCCTCCTGGTCCAACCGCAACCTGT
CCGAGATCTGGGACAACATGACCTGGCTGCAGTGGGACAAGGAGATCTCCAACTACACCCAGATCATCTACGGCCTGCTGGAGGAG
TCCCAGAACCAGCAGGAGAAGAACGAGCAGGACCTGCTGGCCCTGGACTAGGGATCC

>HV1301289_G458Y gtcgacAAGCTTcccgggccaccATGCCCATGGGCTCCCTGCAGCCCCTGGCCACCCTGTACCTGCTGGGCATGCTGGTGGCCTCCGTGCT
GGCCGCCGAGAACCTGTGGGTGACCGTGTACTACGGCGTGCCCGTGTGGAAGGAGGCCAAGACCACCCTGTTCTGCGCCTCCGACG
CCAAGGCCTACGAGAAGAAGGTGCACAACGTGTGGGCCACCCACGCCTGCGTGCCCACCGACCCCAACCCCCAGGAGATGGTGCTG
AAGAACGTGACCGAGAACTTCAACATGTGGAAGAACGACATGGTGGACCAGATGCACGAGGACGTGATCTCCCTGTGGGACCAGTC
CCTGAAGCCCTGCGTGAAGCTGACCCCCCTGTGCGTGACCCTGAACTGCACCAACGCCACCGCCTCCAACTCCTCCATCATCGAGGGC
ATGAAGAACTGCTCCTTCAACATCACCACCGAGCTGCGCGACAAGCGCGAGAAGAAGAACGCCCTGTTCTACAAGCTGGACATCGTG
CAGCTGGACGGCAACTCCTCCCAGTACCGCCTGATCAACTGCAACACCTCCGTGATCACCCAGGCCTGCCCCAAGGTGTCCTTCGACC
CCATCCCCATCCACTACTGCGCCCCCGCCGGCTACGCCATCCTGAAGTGCAACAACAAGACCTTCACCGGCACCGGCCCCTGCAACAA
CGTGTCCACCGTGCAGTGCACCCACGGCATCAAGCCCGTGGTGTCCACCCAGCTGCTGCTGAACGGCTCCCTGGCCGAGGGCGAGAT
CATCATCCGCTCCGAGAACATCACCGACAACGGCAAGACCATCATCGTGCACCTGAACGAGTCCGTGAAGATCGAGTGCACCCGCCC
CAACAACAAGACCCGCACCTCCATCCGCATCGGCCCCGGCCAGTGGTTCTACGCCACCGGCCAGGTGATCGGCGACATCCGCGAGGC
CTACTGCAACATCAACGAGTCCAAGTGGAACGAGACCCTGCAGCGCGTGTCCAAGAAGCTGAAGGAGTACTTCCCCCACAAGAACAT
CACCTTCCAGCCCTCCTCCGGCGGCGACCTGGAGATCACCACCCACTCCTTCAACTGCGGCGGCGAGTTCTTCTACTGCAACACCTCCT

Figure 59D

CCCTGTTCAACCGCACCTACATGGCCAACTCCACCGACATGGCCAACTCCACCGAGACCAACTCCACCCGCACCATCACCATCCACTGC
CGCATCAAGCAGATCATCAACATGTGGCAGGAGGTGGGCCGCGCCATGTACGCCCCCCCCATCGCCGGCAACATCACCTGCATCTCC
AACATCACCGGCCTGCTGCTGACCCGCGACTACGGCAAGAACAACACCGAGACCTTCCGCCCCGGCGGCGGCAACATGAAGGACAA
CTGGCGCTCCGAGCTGTACAAGTACAAGGTGGTGAAGATCGAGCCCCTGGGCGTGGCCCCCACCCGCTGCAAGCGCCGCGTGGTGG
GCCGCCGCCGCCGCCGCGCCGTGGGCATCGGCGCCGTGTTCCTGGGCTTCCTGGGCGCCGCCGGCTCCACCATGGGCGCCGCC
TCCATGACCCTGACCGTGCAGGCCCGCAACCTGCTGTCCGGCATCGTGCAGCAGCAGTCCAACCTGCTGCGCGCCCCCGAGGCCCAG
CAGCACCTGCTGAAGCTGACCGTGTGGGGCATCAAGCAGCTGCAGGCCCGCGTGCTGGCCGTGGAGCGCTACCTGCGCGACCAGCA
GCTGCTGGGCATCTGGGGCTGCTCCGGCAAGCTGATCTGCTGCACCAACGTGCCCTGGAACTCCTCCTGGTCCAACCGCAACCTGTCC
GAGATCTGGGACAACATGACCTGGCTGCAGTGGGACAAGGAGATCTCCAACTACACCCAGATCATCTACGGCCTGCTGGAGGAGTC
CCAGAACCAGCAGGAGAAGAACGAGCAGGACCTGCTGGCCCTGGACTAGggatcc >HV1300531_v2_G458Y GTCGACAAGAAGCCACCATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGA
GGTGCACAACGTGTGGGCGACCCACGCCTGCGTGCCCACGGACCCCAACCCGCAGGAGATGGTGCTGAAGAACGTGACCGAGAACT
TCAACATGTGGAAGAACGACATGGTGGACCAGATGCACGAGGACGTGATCTCCCTGTGGGACCAGTCCCTGAAGCCCTGCGTGAAG
CTGACCCCGCTGTGCGTGACCCTGAACTGCACCAACGCCACCGCGTCCAACTCCTCCATCATCGAGGGCATGAAGAACTGCTCCTTCA
ACATCACGACGGAGCTGCGCGACAAGCGCGAGAAGAAGAACGCCCTGTTCTACAAGCTGGACATCGTGCAGCTGGACGGCAACTCC
TCGCAGTACAGGCTGATCAACTGCAACACCTCCGTCATCACGCAGGCGTGCCCCAAGGTGTCCTTCGACCCCATCCCCATCCACTACT
GCGCCCCCGCCGGCTACGCCATCCTGAAGTGCAACAACAAGACCTTCACCGGCACCGGCCCGTGCAACAACGTGTCCACCGTGCAGT
GCACGCACGGGATCAAGCCCGTGGTGTCCACGCAGCTGCTCCTGAACGGGTCGCTGGCCGAGGGCGAGATCATCATCCGGTCCGAG
AACATCACGAAGAACGTGAAGACCATCATCGTGCACCTGAACGAGTCCGTGAAGATCGAGTGCACCCGCCCGAACAACAAGACGCG
CACCTCCATCCGGATCGGCCCTGGCCAGGCCTTCTACGCCACCGGCCAGGTGATCGGCGACATCCGCGAGGCGTACTGCAACATCAA
CGAGTCCAAGTGGAACGAGACCCTGCAGCGCGTGTCCAAGAAGCTGAAGGAGTACTTCCCCCACAAGAACATCACCTTCCAGCCGTC
GTCCGGCGGCGACCTCGAGATCACCACGCACTCCTTCAACTGCGGTGGCGAGTTCTTCTACTGCAACACGTCGTCGCTGTTCAACCGC
ACCTACATGGCCAACTCCACCGACATGGCCAACTCCACCGAGACCAACTCCACGCGCACCATCACGATCCACTGCCGCATCAAGCAGA
TCATCAACATGTGGCAGGAGGTGGGCCGCGCCATGTACGCACCGCCCATCGCCGGCAACATCACCTGCATCTCCAACATCACCGGCC
TCCTGCTGACCCGCGACTACGGCAAGAACAACACGGAGACCTTCAGGCCAGGCGGAGGCAACATGAAGGACAACTGGCGCTCCGA
GCTGTACAAGTACAAGGTGGTGGAGGTGAAGCCCCTGGGCGTGGCACCCACCAACGCCCGCGAGCGCGTCGTGGAGCGCGAGAAG
GAGTAGTAAGGTGACCGAATTCGGGACCCGGATCC

>HV1301349_G458Y

GTCGACAAGCTTCCCGGGCCACCATGCCCATGGGCTCCCTGCAGCCCCTGGCCACCCTGTACCTGCTGGGCATGCTGGTGGCCTCCGT
GCTGGCCGCCGAGAACCTGTGGGTGACCGTGTACTACGGCGTGCCCGTGTGGAAGGAGGCCAAGACCACCCTGTTCTGCGCCTCCG
ACGCCAAGGCCTACGAGAAGGAAGGTGCACAACGTGTGGGCCACCCACGCCTGCGTGCCCACCGACCCCAACCCCCAGGAGATGGTG
CTGAAGAACGTGACCGAGAACTTCAACATGTGGAAGAACGACATGGTGGACCAGATGCACGAGGACGTGATCTCCCTGTGGGACCA
GTCCCTGAAGCCCTGCGTGAAGCTGACCCCCCTGTGCGTGACCCTGAACTGCACCAACGCCACCGCCTCCAACTCCTCCATCATCGAG
GGCATGAAGAACTGCTCCTTCAACATCACCACCGAGCTGCGCGACAAGCGCGAGAAGAAGAACGCCCTGTTCTACAAGCTGGACATC
GTGCAGCTGGACGGCAACTCCTCCCAGTACCGCCTGATCAACTGCAACACCTCCGTGATCACCCAGGCCTGCCCCAAGGTGTCCTTCG
ACCCCATCCCCATCCACTACTGCGCCCCCGCCGGCTACGCCATCCTGAAGTGCAACAACAAGACCTTCACCGGCACCGGCCCCTGCAA
CAACGTGTCCACCGTGCAGTGCACCCACGGCATCAAGCCCGTGGTGTCCACCCAGCTGCTGCTGAACGGCTCCCTGGCCGAGGGCGA
GATCATCATCCGCTCCGAGAACATCACCAAGAACGTGAAGACCATCATCGTGCACCTGAACGAGTCCGTGAAGATCGAGTGCACCCG
CCCCAACAACAAGACCCGCACCTCCATCCGCATCGGCCCCGGCCAGTGGTTCTACGCCACCGGCCAGGTGATCGGCGACATCCGCGA

Figure 59D continued

GGCCTACTGCAACATCAACGAGTCCAAGTGGAACGAGACCCTGCAGCGCGTGTCCAAGAAGCTGAAGGAGTACTTCCCCCACAAGA
ACATCACCTTCCAGCCCTCCTCCGGCGGCGACCTGGAGATCACCACCCACTCCTTCAACTGCGGCGGCGAGTTCTTCTACTGCAACAC
CTCCTCCCTGTTCAACCGCACCTACATGGCCAACTCCACCGACATGGCCAACTCCACCGAGACCAACTCCACCCGCACCATCACCATCC
ACTGCCGCATCAAGCAGATCATCAACATGTGGCAGGAGGTGGGCCGCGCCATGTACGCCCCCCCCATCGCCGGCAACATCACCTGCA
TCTCCAACATCACCGGCCTGCTGCTGACCCGCGAC TA CGGCAAGAACAACACCGAGACCTTCCGCCCCGGCGGCGGCAACATGAAG
GACAACTGGCGCTCCGAGCTGTACAAGTACAAGGTGGTGAAGATCGAGCCCTGGGCGTGGCCCCACCCGCTGCAAGCGCCGCGT
GGTGGGCCGCCGCCGCCGCCGCCGCCGTGGGCATCGGCGCCGTGTTCCTGGGCTTCCTGGGCGCCGCCGGCTCCACCATGGGCG
CCGCCTCCATGACCCTGACCGTGCAGGCCCGCAACCTGCTGTCCGGCATCGTGCAGCAGCAGTCCAACCTGCTGCGCGCCCCCGAGG
CCCAGCAGCACCTGCTGAAGCTGACCGTGTGGGGCATCAAGCAGCTGCAGGCCCGCGTGCTGGCCGTGGAGCGCTACCTGCGCGAC
CAGCAGCTGCTGGGCATCTGGGGCTGCTCCGGCAAGCTGATCTGCTGCACCAACGTGCCCTGGAACTCCTCCTGGTCCAACCGCAAC
CTGTCCGAGATCTGGGACAACATGACCTGGCTGCAGTGGGACAAGGAGATCTCCAACTACACCCAGATCATCTACGGCCTGCTGGAG
GAGTCCCAGAACCAGCAGGAGAAGAACGAGCAGGACCTGCTGGCCCTGGACGGCGGCGGCTCCGGCGACATCATCAAGCTGCTGA
ACGAGCAGGTGAACAAGGAGATGAACTCCTCCAACCTGTACATGTCCATGTCCTCCTGGTGCTACACCCACTCCCTGGACGGCGCCG
GCCTGTTCCTGTTCGACCACGCCGCCGAGGAGTACGAGCACGCCAAGAAGCTGATCATCTTCCTGAACGAGAACAACGTGCCCGTGC
AGCTGACCTCCATCTCCGCCCCCGAGCACAAGTTCGAGGGCCTGACCCAGATCTTCCAGAAGGCCTACGAGCACGAGCAGCACATCT
CCGAGTCCATCAACAACATCGTGGACCACGCCATCAAGTCCAAGGACCACGCCACCTTCAACTTCCTGCAGTGGTACGTGGCCGAGC
AGCACGAGGAGGAGGTGCTGTTCAAGGACATCCTGGACAAGATCGAGCTGATCGGCAACGAGAACCACGGCCTGTACCTGGCCGAC
CAGTACGTGAAGGGCATCGCCAAGTCCCGCAAGTCCTAGTAAGGATCC

>HV1301582

GTCGACAAGCTTCCCGGGCCACCATGCCCATGGGCTCCCTGCAGCCCCTGGCCACCCTGTACCTGCTGGGCATGCTGGTGGCCTCCGT
GCTGGCCGCCGAGAACCTGTGGGTGACCGTGTACTACGGCGTGCCCGTGTGGAAGGAGGCCAAGACCACCCTGTTCTGCGCCTCCG
ACGCCAAGGCCTACGAGAAGAAGGTGCACAACGTGTGGGCCACCCACGCCTGCGTGCCCACCGACCCCAACCCCCAGGAGATGGTG
CTGAAGAACGTGACCGAGAACTTCAACATGTGGAAGAACGACATGGTGGACCAGATGCACGAGGACGTGATCTCCCTGTGGGACCA
GTCCCTGAAGCCCTGCGTGAAGCTGACCCCCCTGTGCGTGACCCTGAACTGCACCAACGCCACCGCCTCCAACTCCTCCATCATCGAG
GGCATGAAGAACTGCTCCTTCAACATCACCACCGAGCTGCGCGACAAGCGCGAGAAGAAGAACGCCCTGTTCTACAAGCTGGACATC
GTGCAGCTGGACGGCAACTCCTCCCAGTACCGCCTGATCAACTGCAACACCTCCGTGTGCACCCAGGCCTGCCCCAAGGTGTCCTTCG
ACCCCATCCCCATCCACTACTGCGCCCCCGCCGGCTACGCCATCCTGAAGTGCAACAACAAGACCTTCAACGGCACCGGCCCCTGCAA
CAACGTGTCCACCGTGCAGTGCACCCACGGCATCAAGCCCGTGGTGTCCACCCAGCTGCTGCTGAACGGCTCCCTGGCCGAGGGCGA
GATCATCATCCGCTCCGAGAACATCACCAAGAACGTGAAGACCATCATCGTGCACCTGAACGAGTCCGTGAAGATCGAGTGCACCCG
CCCCAACAACAAGACCCGCACCTCCATCCGCATCGGCCCCGGCCAGTGGTTCTACGCCACCGGCCAGGTGATCGGCGACATCCGCGA
GGCCTACTGCAACATCAACGAGTCCAAGTGGAACGAGACCCTGCAGCGCGTGTCCAAGAAGCTGAAGGAGTACTTCCCCCACAAGA
ACATCACCTTCCAGCCCTCCTCCGGCGGCGACCTGGAGATCACCACCCACTCCTTCAACTGCGGCGGCGAGTTCTTCTACTGCAACAC
CTCCTCCCTGTTCAACCGCACCTACATGGCCAACTCCACCGACATGGCCAACTCCACCGAGACCAACTCCACCCGCACCATCACCATCC
ACTGCCGCATCAAGCAGATCATCAACATGTGGCAGGAGGTGGGCCGC TG CATGTACGCCCCCCCCATCGCCGGCAACATCACCTGCA
TCTCCAACATCACCGGCCTGCTGCTGACCCGCGACTACGGCAAGAACAACACCGAGACCTTCCGCCCCGGCGGCGGCAACATGAAGG
ACAACTGGCGCTCCGAGCTGTACAAGTACAAGGTGGTGAAGATCGAGCCCTGGGCGTGGCCCCACCCGCTGCAAGCGCCGCGTG
GTGGGCCGCCGCCGCCGCCGCCGCCGTGGGCATCGGCGCCGTGTTCCTGGGCTTCCTGGGCGCCGCCGGCTCCACCATGGGCGC
CGCCTCCATGACCCTGACCGTGCAGGCCCGCAACCTGCTGTCCGGCATCGTGCAGCAGCAGTCCAACCTGCTGCGCGCCCCCGAGGC
CCAGCAGCACCTGCTGAAGCTGACCGTGTGGGGCATCAAGCAGCTGCAGGCCCGCGTGCTGGCCGTGGAGCGCTACCTGCGCGACC
AGCAGCTGCTGGGCATCTGGGGCTGCTCCGGCAAGCTGATCTGCTGCACCAACGTGCCCTGGAACTCCTCCTGGTCCAACCGCAACC
TGTCCGAGATCTGGGACAACATGACCTGGCTGCAGTGGGACAAGGAGATCTCCAACTACACCCAGATCATCTACGGCCTGCTGGAG
GAGTCCCAGAACCAGCAGGAGAAGAACGAGCAGGACCTGCTGGCCCTGGACTAGGGATCC

<u>GTCGAC</u>GCCACCATGCCTATGGGATCTCTGCAGCCTCTGGCCACACTGTACCTGCTGGGAATGCTGGTGGCTTCTGTGCTGGCCGCC
GAGAATCTGTGGGTCACAGTGTACTATGGCGTGCCCGTGTGGAAGGACGCCGAGACAACACTGTTTTGTGCCAGCGACGCCAAGGC
CTACGAGAAGAAAAAGCGGAACGTGTGGGCCACACACTGCTGCGTGCCAACAGACCCCAATCCTCAAGAGATGGTGCTGAAGAACG
TGACCGAGAACTTCAACATGTGGAAGAACGACATGGTGGACCAGATGCACACCGACGTGATCAGCCTGTGGGACCAGAGCCTGAAG
CCTTGCGTGAAGCTGACCCCTCTGTGCGTGACCCTGAACTGCACAAATGCCACCGCCAGCAACAGCAGCATCATCGAGGGCATGAAG
AACTGCAGCTTCAACATCACCACCGAGCTGCGCGACAAGCGCGAGAAGAAGAACGCCCTGTTCTACAAGCTGGACATCGTGCAGCTG
GACGGCAACAGCTCCCAGTACAGACTGATCAACTGCAACACCAGCGTGATCACCCAGGCCTGTCCTAAGGTGTCCTTCGATCCCATTC
CTATCCACTACTGTGCCCCTGCCGGCTACGCCATCCTGAAGTGCAACAACAAGACCTTCACCGGCACAGGCCCCTGCAACAATGTGTC
CACCGTGCAGTGTACCCACGGCATCAAGCCTGTGGTGTCTACCCAGCTGCTGCTGAATGGATCTCTGGCCGAGGGCGAGATCATCAT
CAGAAGCGAGAATATCACCAACAAGGTCAAGACCATCATCGTGCACCTGAAGGAGAGCGTGAAGATCGAGTGCACCCGGCCTAACA
ACAAAACCCGGACCAGCATCAGAATCGGCCCTGGCCAGTGGTTTTACGCCACCGGACAAGTGATCGGCGACATCAGAGAGGCCTAC
TGCAACATCAACGAGAGCAAGTGGAACGAGACACTGCAGCGGGTGTCCAAGAAGCTGAAAGAGTACTTCCCTCACAAGAACATCAC
CTTCCAGCCTAGCTCTGGCGGCGACCTGGAAATCACCACACACAGCTTCAATTGTGGCGGCGAGTTCTTCTACTGCAATACCTCCAGC
CTGTTCAACCGGACCTACATGGCCAACTCCACCGATATGGCCAACAGCACCGAGACAAACAGCACCAGAACCATCACCATCCACTGCC
GGATCAAGCAGATCATCAATATGTGGCAGCGCGTCGGCCAGGCTATGTACGCTCCTCCTATCGCCGGCAACATCACATGCATCAGCA
ATATCACCGGCCTGCTGCTCACCAGAGATGGCTACAAGAACAACACCGAAACCTTCAGACCCGGCGGAGGCAACATGAAGGACAAT
TGGAGAAGCGAGCTGTACAAGTACAAGGTGGTCAAGATCGAGCCCCTGGGCGTCGCACCTACACGGTGCAAGAGAAGAGTCGTGG
GCCGTCGTAGAAGGCGGAGAGCCGTTGGAATTGGCGCCGTGTTCCTGGGCTTTCTGGGAGCCGCTGGATCTACAATGGGCGCTGCC
AGCATGACCCTGACAGTGCAGGCTAGAAATCTGCTGAGCGGCATTGTGCAGCAGCAGAGCAACCTGCTGAGAGCCCCTGAGTGTCA
GCAGCACCTCCTGAAACTGACCGTGTGGGGAATCAAGCAGCTGCAGGCAAGAGTGCTGGCTGTGGAAAGATACCTGCGGGACCAGC
AGCTCCTCGGCATCTGGGGATGTTCTGGCAAGCTGATCTGCTGCACCAACGTGCCCTGGAACAGCTCCTGGTCCAACAGAAACCTGA
GCGAGATCTGGGACAACATGACCTGGCTGCAGTGGGACAAAGAGATCAGCAACTACACCCAGATCATCTACGGACTGCTGGAAGAG
AGCCAGAACCAGCAAGAGAAAAACGAGCAGGACCTGCTGGCCCTGGACTGATAA<u>GGATCC</u>

>HV1301597_G458Y_avi.2

<u>TCTAGA</u>CCACCATGCCCATGGGCAGCCTGCAGCCCCTGGCCACCCTGTACCTGCTGGGCATGCTGGTGGCTAGCGTGCTGGCCGCCG
AGAACCTGTGGGTGACCGTCTACTATGGCGTGCCCGTCTGGAAGGAAGCCAAAACCACACTGTTCTGCGCTAGCGACGCTAAGGCAT
ACGAGAAAAAAGTGCACAATGTCTGGGCTACTCATGCATGCGTGCCTACCGATCCAAATCCCCAGGAGATGGTGCTGAAGAACGTCA
CAGAAAACTTTAATATGTGGAAGAACGACATGGTGGATCAGATGCACGAGGACGTGATCAGCCTGTGGGATCAGTCCCTGAAGCCA
TGCGTGAAACTGACTCCCCTGTGCGTCACCCTGAACTGTACTAATGCCACCGCTTCCAACAGCTCCATCATTGAGGGGATGAAGAACT
GTTCTTTCAATATCACTACCGAGCTGCGCGACAAGCGAGAAAAGAAAAATGCCCTGTTTTACAAACTGGACATCGTGCAGCTGGATG
GCAACTCTAGTCAGTATAGACTGATTAACTGCAATACAAGCGTGATCACTCAGGCATGTCCAAAGGTCAGTTTCGATCCTATTCCAAT
CCACTACTGCGCACCCGCCGGATATGCTATCCTGAAGTGTAACAACAAGACCTTCACCGGCACTGGGCCTTGCAACAACGTGAGCAC
CGTCCAGTGTACACATGGCATTAAGCCAGTGGTCAGCACCCAGCTGCTGCTGAACGGCAGCCTGGCAGAGGGCGAAATCATTATCCG
CAGCGAGAACATCACAAATAATGTGAAGACTATCATCGTCCACCTGAACGAGAGCGTGAAGATTGAAGGCACACGGCCCAACAACA
AGACCAGGACATCCATTCGCATCGGACCTGGCCAGTGGTTCTACGCTACTGGCCAGGTCATCGGGGACATCAGAGAGGCCTATTGTA
ACATCAATGAGTCAAAGTGGAATGAAACTCTGCAGAGGGTGAGCAAGAAACTGAAGGAATACTTCCCTCACAAAAACATCACCTTTC
AGCCATCAAGCGGCGGGGACCTGGAGATTACAACTCATTCTTTCAATTGCGGAGGCGAATTCTTTTACTGTAACACCTCCTCTCTGTTT
AATCGCACATATATGGCTAACAGTACTGATATGGCAAACTCTACTGAGACCAATAGTACACGAACTATTACCATCCATTGCCGGATCA
AGCAGATTATCAACATGTGGCAGGAAGTGGGGCGGGCCATGTATGCTCCCCCTATTGCAGGAAATATTACCTGTATCAGCAACATTA
CCGGCCTGCTGCTGACAAGAGACTATGGAAAGAACAATACAGAGACTTTTAGGCCTGGCGGGGGAAACATGAAAGATAATTGGCGC
TCCGAGCTGTACAAGTATAAAGTGGTCAAGATCGAACCACTGGGAGTGGCACCTACCCGATGTAAACGGAGAGTGGTCGGAAGGCG
CCGACGGAGAAGGGCAGTGGGAATCGGAGCCGTCTTCCTGGGCTTTCTGGGAGCAGCTGGCAGCACAATGGGAGCAGCCTCTATG

Figure 59D continued

ACCCTGACAGTGCAGGCTCGAAATCTGCTGAGTGGGATCGTGCAGCAGCAGTCAAACCTGCTGCGAGCACCAGAGGCACAGCAGCA
TCTGCTGAAGCTGACCGTGTGGGGCATCAAGCAGCTGCAGGCCAGAGTGCTGGCTGTCGAACGGTACCTGAGAGATCAGCAGCTGC
TGGGAATCTGGGGATGCAGCGGAAAGCTGATTTGCTGTACAAACGTGCCCTGGAATAGTTCATGGTCAAACAGGAATCTGAGCGAG
ATCTGGGACAATATGACCTGGCTGCAGTGGGATAAGGAAATCAGTAACTACACACAGATCATCTATGGCCTGCTGGAGGAATCACAG
AACCAGCAGGAGAAAAATGAACAGGACCTGCTGGCCCTGGATGGCGGCGGCGGCAGCGGACTGAACGACATCTTCGAGGCCCAGA
AGATCGAGTGGCACGAGTGATGAGGATCC

>HV1301606_G458Y

GTCGACAAGCTTCCCGGGCCACCATGCCCATGGGCTCCCTGCAGCCCCTGGCCACCCTGTACCTGCTGGGCATGCTGGTGGCCTCCGT
GCTGGCCGCCGAGAACCTGTGGGTGACCGTGTACTACGGCGTGCCCGTGTGGAAGGAGGCCAAGACCACCCTGTTCTGCGCCTCCG
ACGCCAAGGCCTACGAGAAGAAGGTGCACAACGTGTGGGCCACCCACTGCTGCGTGCCCACCGACCCCAACCCCCAGGAGATGGTG
CTGAAGAACGTGACCGAGAACTTCAACATGTGGAAGAACGACATGGTGGACCAGATGCACGAGGACGTGATCTCCCTGTGGGACCA
GTCCCTGAAGCCCTGCGTGAAGCTGACCCCCCTGTGCGTGACCCTGAACTGCACCAACGCCACCGCCTCCAACTCCTCCATCATCGAG
GGCATGAAGAACTGCTCCTTCAACATCACCACCGAGCTGCGCGACAAGCGCGAGAAGAAGAACGCCCTGTTCTACAAGCTGGACATC
GTGCAGCTGGACGGCAACTCCTCCCAGTACCGCCTGATCAACTGCAACACCTCCGTGATCACCCAGGCCTGCCCCAAGGTGTCCTTCG
ACCCCATCCCCATCCACTACTGCGCCCCCGCCGGCTACGCCATCCTGAAGTGCAACAACAAGACCTTCACCGGCACCGGCCCCTGCAA
CAACGTGTCCACCGTGCAGTGCACCCACGGCATCAAGCCCGTGGTGTCCACCCAGCTGCTGCTGAACGGCTCCCTGGCCGAGGGCGA
GATCATCATCCGCTCCGAGAACATCACCAAGAACGTGAAGACCATCATCGTGCACCTGAACGAGTCCGTGAAGATCGAGTGCACCCG
CCCCAACAACAAGACCCGCACCTCCATCCGCATCGGCCCCGGCCAGTGGTTCTACGCCACCGGCCAGGTGATCGGCGACATCCGCGA
GGCCTACTGCAACATCAACGAGTCCAAGTGGAACGAGACCCTGCAGCGCGTGTCCAAGAAGCTGAAGGAGTACTTCCCCCACAAGA
ACATCACCTTCCAGCCCTCCTCCGGCGGCGACCTGGAGATCACCACCCACTCCTTCAACTGCGGCGGCGAGTTCTTCTACTGCAACAC
CTCCTCCCTGTTCAACCGCACCTACATGGCCAACTCCACCGACATGGCCAACTCCACCGAGACCAACTCCACCCGCACCATCACCATCC
ACTGCCGCATCAAGCAGATCATCAACATGTGGCAGGAGGTGGGCCGCGCCATGTACGCCCCCCCCATCGCCGGCAACATCACCTGCA
TCTCCAACATCACCGGCCTGCTGCTGACCCGCGACTACGGCAAGAACAACACCGAGACCTTCCGCCCCGGCGGCGGCAACATGAAGG
ACAACTGGCGCTCCGAGCTGTACAAGTACAAGGTGGTGAAGATCGAGCCCCTGGGCGTGGCCCCACCCGCTGCAAGCGCCGCGTG
GTGGGCCGCCGCCGCCGCCGCGCCGTGGGCATCGGCGCCGTGTTCCTGGGCTTCCTGGGCGCCGCCGGCTCCACCATGGGCGC
CGCCTCCATGACCCTGACCGTGCAGGCCCGCAACCTGCTGTCCGGCATCGTGCAGCAGCAGTCCAACCTGCTGCGCGCCCCCGAGTG
CCAGCAGCACCTGCTGAAGCTGACCGTGTGGGGCATCAAGCAGCTGCAGGCCCGCGTGCTGGCCGTGGAGCGCTACCTGCGCGACC
AGCAGCTGCTGGGCATCTGGGGCTGCTCCGGCAAGCTGATCTGCTGCACCAACGTGCCCTGGAACTCCTCCTGGTCCAACCGCAACC
TGTCCGAGATCTGGGACAACATGACCTGGCTGCAGTGGGACAAGGAGATCTCCAACTACACCCAGATCATCTACGGCCTGCTGGAG
GAGTCCCAGAACCAGCAGGAGAAGAACGAGCAGGACCTGCTGGCCCTGGACTAGGGATCC

Figure 59D continued

```
Query    1    MPMGSLQPLATLYLLGMLVASVLAAENLWVTVYYGVPVWKEAKTTLFCASDAKAYEKKVH    60
              MPMGSLQPLATLYLLGMLVASVLAAENLWVTVYYGVPVWKEAKTTLFCASDAKAYEKKVH
Sbjct    1    MPMGSLQPLATLYLLGMLVASVLAAENLWVTVYYGVPVWKEAKTTLFCASDAKAYEKKVH    60

Query    61   NVWATHACVPTDPNPQEMVLKNVTENFNMWKNDMVDQMHEDVISLWDQSLKPCVKLTPLC   120
              NVWATHACVPTDPNPQEMVLKNVTENFNMWKNDMVDQMHEDVISLWDQSLKPCVKLTPLC
Sbjct    61   NVWATHACVPTDPNPQEMVLKNVTENFNMWKNDMVDQMHEDVISLWDQSLKPCVKLTPLC   120

Query    121  VTLNCTNATASNSSIIEGMKNCSFNITTELRDKPEKKNALFYKLDIVQLDGNSSQYRLIN   180
              VTLNCTNATASNSSIIEGMKNCSFNITTELRDK EKKNALFYKLDIVQLDGNSSQYRLIN
Sbjct    121  VTLNCTNATASNSSIIEGMKNCSFNITTELRDKREKKNALFYKLDIVQLDGNSSQYRLIN   180

Query    181  CNTSVITQACPKVSFDPIPIHYCAPAGYAILKCNNKTFTGTGPCNNVSTVQCTHGIKPVV   240
              CNTSVITQACPKVSFDPIPIHYCAPAGYAILKCNNKTFTGTGPCNNVSTVQCTHGIKPVV
Sbjct    181  CNTSVITQACPKVSFDPIPIHYCAPAGYAILKCNNKTFTGTGPCNNVSTVQCTHGIKPVV   240

Query    241  STQLLLNGSLAEGEIIIRSENITKNVKTIIVHLNESVKIECTRPNNKTRTSIRIGPGQWF   300
              STQLLLNGSLAEGEIIIRSENITKNVKTIIVHLNESVKIECTRPNNKTRTSIRIGPGQWF
Sbjct    241  STQLLLNGSLAEGEIIIRSENITKNVKTIIVHLNESVKIECTRPNNKTRTSIRIGPGQWF   300

Query    301  YATGQVIGDIREAYCNINESKWNETLQRVSKKLKEYFPHKNITFQPSSGGDLEITTHSFN   360
              YATGQVIGDIREAYCNINESKWNETLQRVSKKLKEYFPHKNITFQPSSGGDLEITTHSFN
Sbjct    301  YATGQVIGDIREAYCNINESKWNETLQRVSKKLKEYFPHKNITFQPSSGGDLEITTHSFN   360

Query    361  CGGEFFYCNTSSLFNRTYMANSTDMANSTETNSTRTITIHCRIKQIINMWQEVGRAMYAP   420
              CGGEFFYCNTSSLFNRTYMANSTDMANSTETNSTRTITIHCRIKQIINMWQEVGRAMYAP
Sbjct    361  CGGEFFYCNTSSLFNRTYMANSTDMANSTETNSTRTITIHCRIKQIINMWQEVGRAMYAP   420

Query    421  PIAGNITCISNITGLLLTRDYGKNNTETFRPGGGNMKDNWRSELYKYKVVKIEPLGVAPT   480
              PIAGNITCISNITGLLLTRD GKNNTETFRPGGGNMKDNWRSELYKYKVVKIEPLGVAPT
Sbjct    421  PIAGNITCISNITGLLLTRDGGKNNTETFRPGGGNMKDNWRSELYKYKVVKIEPLGVAPT   480
```

Figure 59E

```
Query  481  RCKRRVVGRPPPPRRAVGIGAVFLGFLGAAGSTMGAASMTLTVQARNLLSGIVQQQSNLLR  540
            RCKRRVVGRPPPPRRAVGIGAVFLGFLGAAGSTMGAASMTLTVQARNLLSGIVQQQSNLLR
Sbjct  481  RCKRRVVGRPPPPRRAVGIGAVFLGFLGAAGSTMGAASMTLTVQARNLLSGIVQQQSNLLR  540

Query  541  APEAQQHLLKLTVWGIKQLQARVLAVERYLRDQQLLGIWGCSGKLICCTNVPWNSSWSNR   600
            APEAQQHLLKLTVWGIKQLQARVLAVERYLRDQQLLGIWGCSGKLICCTNVPWNSSWSNR
Sbjct  541  APEAQQHLLKLTVWGIKQLQARVLAVERYLRDQQLLGIWGCSGKLICCTNVPWNSSWSNR   600

Query  601  NLSEIWDNMTWLQWDKEISNYTQIIYGLLEESQNQQEKNEQDLLALD  647
            NLSEIWDNMTWLQWDKEISNYTQIIYGLLEESQNQQEKNEQDLLALD
Sbjct  601  NLSEIWDNMTWLQWDKEISNYTQIIYGLLEESQNQQEKNEQDLLALD  647
```

QUERY IS HV1301288_G458Y (CH505M5chim.6R.SOSIP.664v4.1_G458Y) (Y458 is bolded and underlined)

Subject is HV1301288 (CH505M5chim.6R.SOSIP.664v4.1) from Figure 23A.

(G458 is bolded and underlined)

Figure 59E continued

- Used site-directed mutagenesis to remove the cysteines.
- The naturally occurring residues were used to replace the two cysteines.

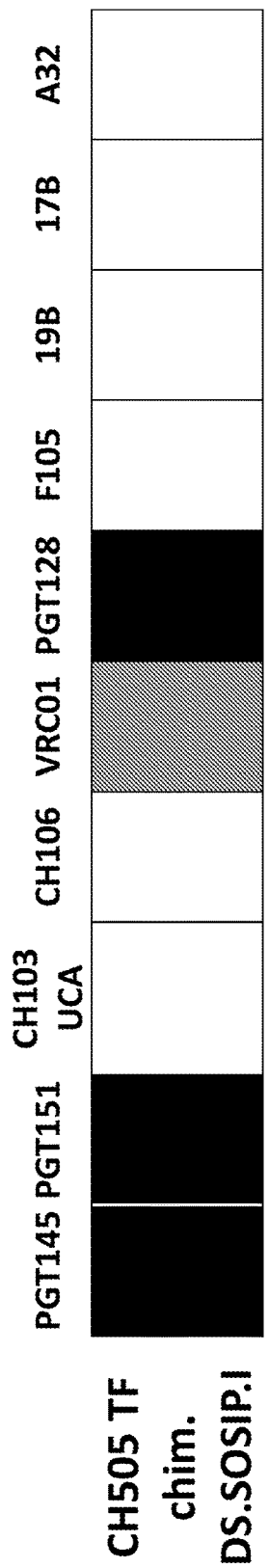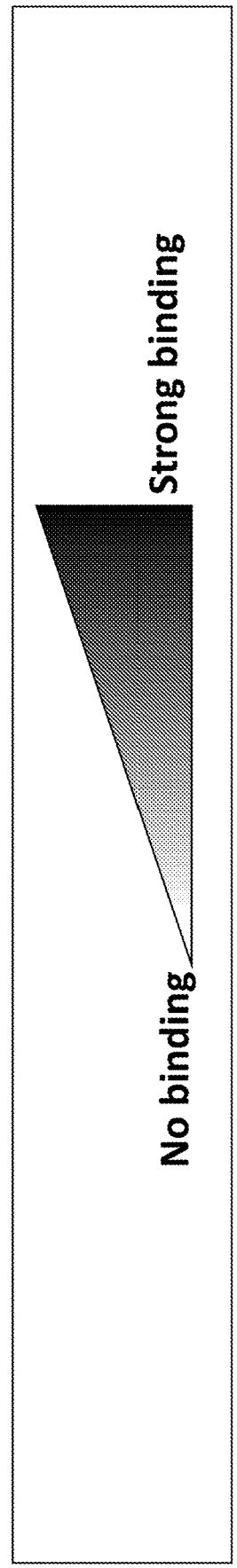
Figure 66

The glycosylation and disulfide bonds analysis is underway and for the completed Envs appears as expected.

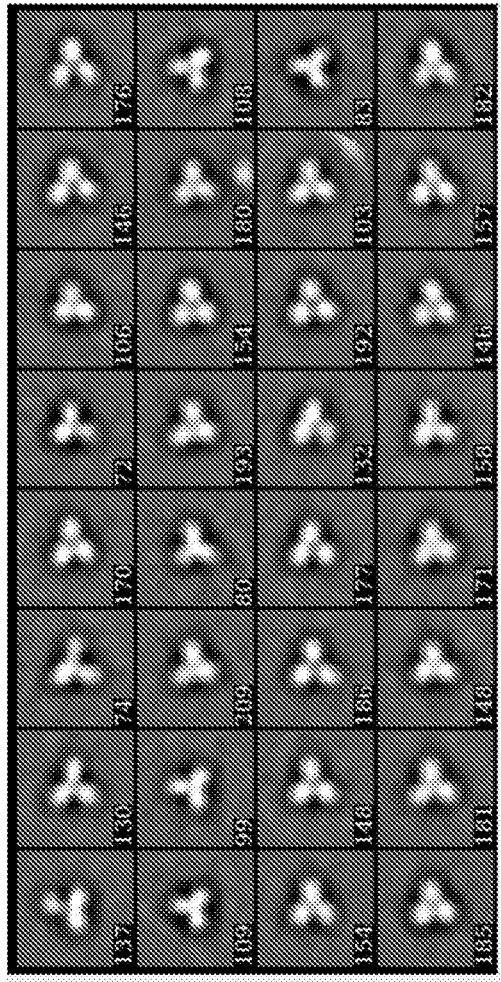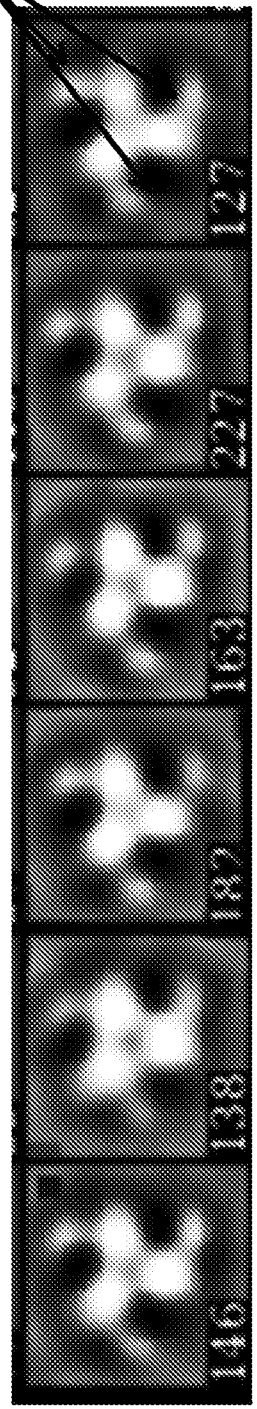
Figure 71

>CH505M5gp160G458Y
MWVTVYYGVPVWKEAKTTLFCASDAKAYEKEVHNVWATHACVPTDPNPQEMVLKNVTENFNMWKNDMVDQMHEDVIS
LWDQSLKPCVKLTPLCVTLNCTNATASNSSIIEGMKNCSFNITTELRDKREKKNALFYKLDIVQLDGNSSQYRLINC
NTSVITQACPKVSFDPIPIHYCAPAGYAILKCNNKTFTGTGPCNNVSTVQCTHGIKPVVSTQLLLNGSLAEGEIIIR
SENITKNVKTIIVHLNESVKIECTRPNNKTRTSIRIGPGQAFYATGQVIGDIREAYCNINESKWNETLQRVSKKLKE
YFPHKNITFQPSSGGDLEITTHSFNCGGEFFYCNTSSLFNRTYMANSTDMANSTETNSTRTITIHCRIKQIINMWQE
VGRAMYAPPIAGNITCISNITGLLLTRDYGKNNTETFRPGGGNMKDNWRSELYKYKVVEVKPLGVAPTNARRRVVER
EKRAVGMGAVFLGFLGAAGSTMGAASITLTVQARQLLSGIVQQQSNLLKAIEAQQHMLKLTVWGIKQLQARVLALER
YLKDQQLLGMWGCSGKLICTTNVYWNSSWSNKTYGDIWDNMTWMQWEREISNYTEIIYELLEESQNQQEKNEQDLLA
LDRWNSLWNWFNITNWLWYIKIFIMIVGGLIGLRIIFAVLSLVNRVRQGYSPLSLQTLIPSPRGPDRPGGIEEEGGE
QDRNRSTPLVSGFLALVWDDLRSLCLFIYHRLRDFILIAARAGELLGRSSLKGLRRGWEALKYLGSLVQYWGLELKR
SAISLLDTLAIAVGEGTDRILEFVLGICRAIRNIPTRIRQGFETALL**
>CH505M5gp140cG458Y
MWVTVYYGVPVWKEAKTTLFCASDAKAYEKEVHNVWATHACVPTDPNPQEMVLKNVTENFNMWKNDMVDQMHEDVIS
LWDQSLKPCVKLTPLCVTLNCTNATASNSSIIEGMKNCSFNITTELRDKREKKNALFYKLDIVQLDGNSSQYRLINC
NTSVITQACPKVSFDPIPIHYCAPAGYAILKCNNKTFTGTGPCNNVSTVQCTHGIKPVVSTQLLLNGSLAEGEIIIR
SENITKNVKTIIVHLNESVKIECTRPNNKTRTSIRIGPGQAFYATGQVIGDIREAYCNINESKWNETLQRVSKKLKE
YFPHKNITFQPSSGGDLEITTHSFNCGGEFFYCNTSSLFNRTYMANSTDMANSTETNSTRTITIHCRIKQIINMWQE
VGRAMYAPPIAGNITCISNITGLLLTRDYGKNNTETFRPGGGNMKDNWRSELYKYKVVEVKPLGVAPTNARERVVER
EKEAVGMGAVFLGFLGAAGSTMGAASITLTVQARQLLSGIVQQQSNLLKAIEAQQHMLKLTVWGIKQLQARVLALER
YLKDQQLLGMWGCSGKLICTTNVYWNSSWSNKTYGDIWDNMTWMQWEREISNYTEIIYELLEESQNQQEKNEQDLLA
LDRWNSLWNWFNITNWLWYIK**
>CH505M5gp120G458Y
MWVTVYYGVPVWKEAKTTLFCASDAKAYEKEVHNVWATHACVPTDPNPQEMVLKNVTENFNMWKNDMVDQMHEDVIS
LWDQSLKPCVKLTPLCVTLNCTNATASNSSIIEGMKNCSFNITTELRDKREKKNALFYKLDIVQLDGNSSQYRLINC
NTSVITQACPKVSFDPIPIHYCAPAGYAILKCNNKTFTGTGPCNNVSTVQCTHGIKPVVSTQLLLNGSLAEGEIIIR
SENITKNVKTIIVHLNESVKIECTRPNNKTRTSIRIGPGQAFYATGQVIGDIREAYCNINESKWNETLQRVSKKLKE
YFPHKNITFQPSSGGDLEITTHSFNCGGEFFYCNTSSLFNRTYMANSTDMANSTETNSTRTITIHCRIKQIINMWQE
VGRAMYAPPIAGNITCISNITGLLLTRDYGKNNTETFRPGGGNMKDNWRSELYKYKVVEVKPLGVAPTNARERVVER
EKE**
>CH505M5chim.6R.SOSIP.664v4.1G458Y
AENLWVTVYYGVPVWKEAKTTLFCASDAKAYEKKVHNVWATHACVPTDPNPQEMVLKNVTENFNMWKNDMVDQMHED
VISLWDQSLKPCVKLTPLCVTLNCTNATASNSSIIEGMKNCSFNITTELRDKREKKNALFYKLDIVQLDGNSSQYRL
INCNTSVITQACPKVSFDPIPIHYCAPAGYAILKCNNKTFTGTGPCNNVSTVQCTHGIKPVVSTQLLLNGSLAEGEI
IIRSENITKNVKTIIVHLNESVKIECTRPNNKTRTSIRIGPGQWFYATGQVIGDIREAYCNINESKWNETLQRVSKK
LKEYFPHKNITFQPSSGGDLEITTHSFNCGGEFFYCNTSSLFNRTYMANSTDMANSTETNSTRTITIHCRIKQIINM
WQEVGRAMYAPPIAGNITCISNITGLLLTRDYGKNNTETFRPGGGNMKDNWRSELYKYKVVKIEPLGVAPTRCKRRV
VGRRRPPRAVGIGAVFLGFLGAAGSTMGAASMTLTVQARNLLSGIVQQQSNLLRAPEAQQHLLKLTVWGIKQLQARV
LAVERYLRDQQLLGIWGCSGKLICCTNVPWNSSWSNRNLSEIWDNMTWLQWDKEISNYTQIIYGLLEESQNQQEKNE
QDLLALD**
>CH505M5chim.6R.SOSIP.664G458Y
AENLWVTVYYGVPVWKEAKTTLFCASDAKAYEKEVHNVWATHACVPTDPNPQEMVLKNVTENFNMWKNDMVDQMHED
VISLWDQSLKPCVKLTPLCVTLNCTNATASNSSIIEGMKNCSFNITTELRDKREKKNALFYKLDIVQLDGNSSQYRL
INCNTSVITQACPKVSFDPIPIHYCAPAGYAILKCNNKTFTGTGPCNNVSTVQCTHGIKPVVSTQLLLNGSLAEGEI
IIRSENITKNVKTIIVHLNESVKIECTRPNNKTRTSIRIGPGQAFYATGQVIGDIREAYCNINESKWNETLQRVSKK
LKEYFPHKNITFQPSSGGDLEITTHSFNCGGEFFYCNTSSLFNRTYMANSTDMANSTETNSTRTITIHCRIKQIINM
WQEVGRAMYAPPIAGNITCISNITGLLLTRDYGKNNTETFRPGGGNMKDNWRSELYKYKVVKIEPLGVAPTRCKRRV
VGRRRRRRAVGIGAVFLGFLGAAGSTMGAASMTLTVQARNLLSGIVQQQSNLLRAPEAQQHLLKLTVWGIKQLQARV
LAVERYLRDQQLLGIWGCSGKLICCTNVPWNSSWSNPNLSEIWDNMTWLQWDKEISNYTQIIYGLLEESQNQQEKNE
QDLLALD**

Figure 81

>CH505M11gp160G458Y
MWVTVYYGVPVWKEAKTTLFCASDAKAYEKEVHNVWATHACVPTDPNPQEMVLKNVTENFNMWKNDMVDQMHEDVIS
LWDQSLKPCVKLTPLCVTLNCTNATASNSSIIEGMKNCSFNITTELRDKREKKNALFYKLDIVQLDGNSSQYRLINC
NTSVITQACPKVSFDPIPIHYCAPAGYAILKCNNKTFTGTGPCNNVSTVQCTHGIKPVVSTQLLLNGSLAEGEIIIR
SENITDNGKTIIVHLNESVKIECTRPNNKTRTSIRIGPGQAFYATGQVIGDIREAYCNINESKWNETLQRVSKKLKE
YFPHKNITFQPSSGGDLEITTHSFNCGGEFFYCNTSSLFNRTYMANSTDMANSTETNSTRTITIHCRIKQIINMWQE
VGRAMYAPPIAGNITCISNITGLLLTRDYGKNNTETFRPGGGNMKDNWRSELYKYKVVEVKPLGVAPTNARRRVVER
EKRAVGMGAVFLGFLGAAGSTMGAASITLTVQAPQLLSGIVQQQSNLLKAIEAQQHMLKLTVWGIKQLQARVLALER
YLKDQQLLGMWGCSGKLICTTNVYWNSSWSNKTYGDIWDNMTWMQWEREISNYTEIIYELLEESQNQQEKNEQDLLA
LDRWNSLWNWFNITNWLWYIKIFIMIVGGLIGLRIIFAVLSLVNRVRQGYSPLSLQTLIPSPRGPDRPGGIEEEGGE
QDRNRSTRLVSGFLALVWDDLRSLCLFIYHRLRDFILIAARAGELLGRSSLKGLRRGWEALKYLGSLVQYWGLELKR
SAISLLDTLAIAVGEGTDRILEFVLGICRAIRNIPTRIRQGFETALL**
>CH505M11gp140cG458Y
MWVTVYYGVPVWKEAKTTLFCASDAKAYEKEVHNVWATHACVPTDPNPQEMVLKNVTENFNMWKNDMVDQMHEDVIS
LWDQSLKPCVKLTPLCVTLNCTNATASNSSIIEGMKNCSFNITTELRDKREKKNALFYKLDIVQLDGNSSQYRLINC
NTSVITQACPKVSFDPIPIHYCAPAGYAILKCNNKTFTGTGPCNNVSTVQCTHGIKPVVSTQLLLNGSLAEGEIIIR
SENITDNGKTIIVHLNESVKIECTRPNNKTRTSIRIGPGQAFYATGQVIGDIREAYCNINESKWNETLQRVSKKLKE
YFPHKNITFQPSSGGDLEITTHSFNCGGEFFYCNTSSLFNRTYMANSTDMANSTETNSTRTITIHCRIKQIINMWQE
VGRAMYAPPIAGNITCISNITGLLLTRDYGKNNTETFRPGGGNMKDNWRSELYKYKVVEVKPLGVAPTNARERVVER
EKEAVGMGAVFLGFLGAAGSTMGAASITLTVQARQLLSGIVQQQSNLLKAIEAQQHMLKLTVWGIKQLQARVLALER
YLKDQQLLGMWGCSGKLICTTNVYWNSSWSNKTYGDIWDNMTWMQWEREISNYTEIIYELLEESQNQQEKNEQDLLA
LDRWNSLWNWFNITNWLWYIK**
>CH505M11gp120G458Y
MWVTVYYGVPVWKEAKTTLFCASDAKAYEKEVHNVWATHACVPTDPNPQEMVLKNVTENFNMWKNDMVDQMHEDVIS
LWDQSLKPCVKLTPLCVTLNCTNATASNSSIIEGMKNCSFNITTELRDKREKKNALFYKLDIVQLDGNSSQYRLINC
NTSVITQACPKVSFDPIPIHYCAPAGYAILKCNNKTFTGTGPCNNVSTVQCTHGIKPVVSTQLLLNGSLAEGEIIIR
SENITDNGKTIIVHLNESVKIECTRPNNKTRTSIRIGPGQAFYATGQVIGDIREAYCNINESKWNETLQRVSKKLKE
YFPHKNITFQPSSGGDLEITTHSFNCGGEFFYCNTSSLFNRTYMANSTDMANSTETNSTRTITIHCRIKQIINMWQE
VGRAMYAPPIAGNITCISNITGLLLTRDYGKNNTETFRPGGGNMKDNWRSELYKYKVVEVKPLGVAPTNARERVVER
EKE**
>CH505M11chim.6R.SOSIP.664v4.1G458Y
AENLWVTVYYGVPVWKEAKTTLFCASDAKAYEKKVHNVWATHACVPTDPNPQEMVLKNVTENFNMWKNDMVDQMHED
VISLWDQSLKPCVKLTPLCVTLNCTNATASNSSIIEGMKNCSFNITTELRDKREKKNALFYKLDIVQLDGNSSQYRL
INCNTSVITQACPKVSFDPIPIHYCAPAGYAILKCNNKTFTGTGPCNNVSTVQCTHGIKPVVSTQLLLNGSLAEGEI
IIRSENITDNGKTIIVHLNESVKIECTRPNNKTRTSIRIGPGQWFYATGQVIGDIREAYCNINESKWNETLQRVSKK
LKEYFPHKNITFQPSSGGDLEITTHSFNCGGEFFYCNTSSLFNRTYMANSTDMANSTETNSTRTITIHCRIKQIINM
WQEVGRAMYAPPIAGNITCISNITGLLLTRDYGKNNTETFRPGGGNMKDNWRSELYKYKVVKIEPLGVAPTRCKRRV
VGRRPPPRAVGIGAVFLGFLGAAGSTMGAASMTLTVQARNLLSGIVQQQSNLLRAPEAQQHLLKLTVWGIKQLQARV
LAVERYLRDQQLLGIWGCSGKLICCTNVPWNSSWSNRNLSEIWDNMTWLQWDKEISNYTQIIYGLLEESQNQQEKNE
QDLLALD**
>CH505M11chim.6R.SOSIP.664G458Y
AENLWVTVYYGVPVWKEAKTTLFCASDAKAYEKEVHNVWATHACVPTDPNPQEMVLKNVTENFNMWKNDMVDQMHED
VISLWDQSLKPCVKLTPLCVTLNCTNATASNSSIIEGMKNCSFNITTELRDKREKKNALFYKLDIVQLDGNSSQYRL
INCNTSVITQACPKVSFDPIPIHYCAPAGYAILKCNNKTFTGTGPCNNVSTVQCTHGIKPVVSTQLLLNGSLAEGEI
IIRSENITDNGKTIIVHLNESVKIECTRPNNKTRTSIRIGPGQAFYATGQVIGDIREAYCNINESKWNETLQRVSKK
LKEYFPHKNITFQPSSGGDLEITTHSFNCGGEFFYCNTSSLFNRTYMANSTDMANSTETNSTRTITIHCRIKQIINM
WQEVGRAMYAPPIAGNITCISNITGLLLTRDYGKNNTETFRPGGGNMKDNWRSELYKYKVVKIEPLGVAPTRCKRRV
VGRRRRRRAVGIGAVFLGFLGAAGSTMGAASMTLTVQARNLLSGIVQQQSNLLRAPEAQQHLLKLTVWGIKQLQARV
LAVERYLRDQQLLGIWGCSGKLICCTNVPWNSSWSNPNLSEIWDNMTWLQWDKEISNYTQIIYGLLEESQNQQEKNE
QDLLALD**

Figure 81 cont.

>CH505w020.14gp160G458Y
MWVTVYYGVPVWKEAKTTLFCASDAKAYEKEVHNVWATHACVPTDPNPQEMVLKNVTENFNMWKNDMVDQMHEDVIS
LWDQSLKPCVKLTPLCVTLNCTNATASNNSIIEGMKNCSFNITTELRDKREKKNALFYKLDIVQLDGNSSQYRLINC
NTSVITQACPKVSFDPIPIHYCAPAGYAILKCNNKTFTGTGPCNNVSTVQCTHGIKPVVSTQLLLNGSLAEGEIIIR
SENITNNAKTIIVHLNESVKIECTRPNNKTRTSIRIGPGQAFYATGQVIGDIRKAYCNISESKWNETLQRVSKKLKE
YFPHKNITFQPSSGGDLEITTHSFNCGGEFFYCNTSSLFNRTYMANSTDMANSTETNSTRTITLHCRIKQIINMWQE
VGRAMYAPPIAGNITCISNITGLLLTRDYGKNNTETFRPGGGNMKDNWRSELYKYKVVEVKPLGVAPTNARRRVVER
EKRAVGMGAVFLGFLGAAGSTMGAASITLTVQAPQLLSGIVQQQSNLLKAIEAQQHMLKLTVWGIKQLQARVLALER
YLKDQQLLGMWGCSGKLICTTNVYWNSSWSNKTYGDIWDNMTWMQWEREISNYTEIIYELLEESQNQQEKNEQDLLA
LDRWNSLWNWFNITNWLWYIKIFIMIVGGLIGLRIIFAVLSLVNRVRQGYSPLSLQTLIPSPRGPDRPGGIEEEGGE
QDRNRSTPLVSGFLALVWDDLRSLCLFIYHRLRDFILIAARAGELLGRSSLKGLRRGWEALKYLGSLVQYWGLELKR
SAISLLDTLAIAVGEGTDRILEFVLGICRAIRNIPTRIRQGFETALL**
>CH505w020.14gp140cG458Y
MWVTVYYGVPVWKEAKTTLFCASDAKAYEKEVHNVWATHACVPTDPNPQEMVLKNVTENFNMWKNDMVDQMHEDVIS
LWDQSLKPCVKLTPLCVTLNCTNATASNNSIIEGMKNCSFNITTELRDKREKKNALFYKLDIVQLDGNSSQYRLINC
NTSVITQACPKVSFDPIPIHYCAPAGYAILKCNNKTFTGTGPCNNVSTVQCTHGIKPVVSTQLLLNGSLAEGEIIIR
SENITNNAKTIIVHLNESVKIECTRPNNKTRTSIRIGPGQAFYATGQVIGDIRKAYCNISESKWNETLQRVSKKLKE
YFPHKNITFQPSSGGDLEITTHSFNCGGEFFYCNTSSLFNRTYMANSTDMANSTETNSTRTITLHCRIKQIINMWQE
VGRAMYAPPIAGNITCISNITGLLLTRDYGKNNTETFRPGGGNMKDNWRSELYKYKVVEVKPLGVAPTNARERVVER
EKEAVGMGAVFLGFLGAAGSTMGAASITLTVQARQLLSGIVQQQSNLLKAIEAQQHMLKLTVWGIKQLQARVLALER
YLKDQQLLGMWGCSGKLICTTNVYWNSSWSNKTYGDIWDNMTWMQWEREISNYTEIIYELLEESQNQQEKNEQDLLA
LDRWNSLWNWFNITNWLWYIK**
>CH505w020.14gp120G458Y
MWVTVYYGVPVWKEAKTTLFCASDAKAYEKEVHNVWATHACVPTDPNPQEMVLKNVTENFNMWKNDMVDQMHEDVIS
LWDQSLKPCVKLTPLCVTLNCTNATASNNSIIEGMKNCSFNITTELRDKREKKNALFYKLDIVQLDGNSSQYRLINC
NTSVITQACPKVSFDPIPIHYCAPAGYAILKCNNKTFTGTGPCNNVSTVQCTHGIKPVVSTQLLLNGSLAEGEIIIR
SENITNNAKTIIVHLNESVKIECTRPNNKTRTSIRIGPGQAFYATGQVIGDIRKAYCNISESKWNETLQRVSKKLKE
YFPHKNITFQPSSGGDLEITTHSFNCGGEFFYCNTSSLFNRTYMANSTDMANSTETNSTRTITLHCRIKQIINMWQE
VGRAMYAPPIAGNITCISNITGLLLTRDYGKNNTETFRPGGGNMKDNWRSELYKYKVVEVKPLGVAPTNARERVVER
EKE**
>CH505w20.14chim.6R.SOSIP.664v4.1G458Y
AENLWVTVYYGVPVWKEAKTTLFCASDAKAYEKKVHNVWATHACVPTDPNPQEMVLKNVTENFNMWKNDMVDQMHED
VISLWDQSLKPCVKLTPLCVTLNCTNATASNNSIIEGMKNCSFNITTELRDKREKKNALFYKLDIVQLDGNSSQYRL
INCNTSVITQACPKVSFDPIPIHYCAPAGYAILKCNNKTFTGTGPCNNVSTVQCTHGIKPVVSTQLLLNGSLAEGEI
IIRSENITNNAKTIIVHLNESVKIECTRPNNKTRTSIRIGPGQWFYATGQVIGDIRKAYCNISESKWNETLQRVSKK
LKEYFPHKNITFQPSSGGDLEITTHSFNCGGEFFYCNTSSLFNRTYMANSTDMANSTETNSTRTITLHCRIKQIINM
WQEVGRAMYAPPIAGNITCISNITGLLLTRDYGKNNTETFRPGGGNMKDNWRSELYKYKVVKIEPLGVAPTRCKRRV
VGRRPPPRAVGIGAVFLGFLGAAGSTMGAASMTLTVQARNLLSGIVQQQSNLLRAPEAQQHLLKLTVWGIKQLQARV
LAVERYLRDQQLLGIWGCSGKLICCTNVPWNSSWSNRNLSEIWDNMTWLQWDKEISNYTQIIYGLLEESQNQQEKNE
QDLLALD*
>CH505w20.14chim.6R.SOSIP.664G458Y
AENLWVTVYYGVPVWKEAKTTLFCASDAKAYEKEVHNVWATHACVPTDPNPQEMVLKNVTENFNMWKNDMVDQMHED
VISLWDQSLKPCVKLTPLCVTLNCTNATASNNSIIEGMKNCSFNITTELRDKREKKNALFYKLDIVQLDGNSSQYRL
INCNTSVITQACPKVSFDPIPIHYCAPAGYAILKCNNKTFTGTGPCNNVSTVQCTHGIKPVVSTQLLLNGSLAEGEI
IIRSENITNNAKTIIVHLNESVKIECTRPNNKTRTSIRIGPGQAFYATGQVIGDIRKAYCNISESKWNETLQRVSKK
LKEYFPHKNITFQPSSGGDLEITTHSFNCGGEFFYCNTSSLFNRTYMANSTDMANSTETNSTRTITLHCRIKQIINM
WQEVGRAMYAPPIAGNITCISNITGLLLTRDYGKNNTETFRPGGGNMKDNWRSELYKYKVVKIEPLGVAPTRCKRRV
VGRRRRRRAVGIGAVFLGFLGAAGSTMGAASMTLTVQARNLLSGIVQQQSNLLRAPEAQQHLLKLTVWGIKQLQARV
LAVERYLPDQQLLGIWGCSGKLICCTNVPWNSSWSNPNLSEIWDNMTWLQWDKEISNYTQIIYGLLEESQNQQEKNE
QDLLALD*

Figure 81 cont.

>CH505.w30.12gp160G458Y
MWVTVYYGVPVWKEAKTTLFCASDAKAYEKEVHNVWATHACVPTDPNPQEMVLKNVTENFNMWKNDMVDQMHEDVIS
LWDQSLKPCVKLTPLCVTLNCTNATNATASNSSIIEGMKNCSFNITTELRDKREKKNALFYKLDIVQLDGNSSQYRL
INCNTSVITQACPKVSFDPIPIHYCAPAGYAILKCNNKTFTGTGPCNNVSTVQCTHGIKPVVSTQLLLNGSLAEGEI
IIRSENITNNDKTIIVHLNESVKIECTRPSNKTRTSIRIGPGQAFYATGQVIGDIREAYCNISESKWNETLQRVSKK
LKEYFPHKNITFQPSSGGDLEITTHSFNCGGEFFYCNTSSLFNRTYMANSTDMANSTETNSTRNITIHCRIKQIINM
WQEVGRAMYAPPIAGNITCISNITGLLLTRDYGKNDTETFRPGGGNMKDNWRSELYKYKVVEVKPLGVAPTNARRRV
VEREKRAVGMGAVFLGFLGAAGSTMGAASITLTVQARQLLSGIVQQQSNLLKAIEAQQHMLKLTVWGIKQLQARVLA
LERYLKDQQLLGMWGCSGKLICTTNVYWNSSWSNKTYGDIWDNMTWMQWEREISNYTEIIYELLEESQNQQEKNEQD
LLALDRWNSLWNWFNITNWLWYIKIFIMIVGGLIGLRIIFAVLSLVNRVRQGYSPLSLQTLIPSPRGPDRPGGIEEE
GGEQDRNRSTRLVSGFLALVWDDLRSLCLFIYHRLRDFILIAARAGELLGRSSLKGLRRGWEALKYLGSLVQYWGLE
LKRSAISLLDTLAIAVGEGTDRILEFILGICRAIRNIPTRIRQGFETALL**
>CH505.w30.12gp140cG458Y
MWVTVYYGVPVWKEAKTTLFCASDAKAYEKEVHNVWATHACVPTDPNPQEMVLKNVTENFNMWKNDMVDQMHEDVIS
LWDQSLKPCVKLTPLCVTLNCTNATNATASNSSIIEGMKNCSFNITTELRDKREKKNALFYKLDIVQLDGNSSQYRL
INCNTSVITQACPKVSFDPIPIHYCAPAGYAILKCNNKTFTGTGPCNNVSTVQCTHGIKPVVSTQLLLNGSLAEGEI
IIRSENITNNDKTIIVHLNESVKIECTRPSNKTRTSIRIGPGQAFYATGQVIGDIREAYCNISESKWNETLQRVSKK
LKEYFPHKNITFQPSSGGDLEITTHSFNCGGEFFYCNTSSLFNRTYMANSTDMANSTETNSTRNITIHCRIKQIINM
WQEVGRAMYAPPIAGNITCISNITGLLLTRDYGKNDTETFRPGGGNMKDNWRSELYKYKVVEVKPLGVAPTNARERV
VEREKEAVGMGAVFLGFLGAAGSTMGAASITLTVQARQLLSGIVQQQSNLLKAIEAQQHMLKLTVWGIKQLQARVLA
LERYLKDQQLLGMWGCSGKLICTTNVYWNSSWSNKTYGDIWDNMTWMQWEREISNYTEIIYELLEESQNQQEKNEQD
LLALDRWNSLWNWFNITNWLWYIK**
>CH505.w30.12gp120G458Y
MWVTVYYGVPVWKEAKTTLFCASDAKAYEKEVHNVWATHACVPTDPNPQEMVLKNVTENFNMWKNDMVDQMHEDVIS
LWDQSLKPCVKLTPLCVTLNCTNATNATASNSSIIEGMKNCSFNITTELRDKREKKNALFYKLDIVQLDGNSSQYRL
INCNTSVITQACPKVSFDPIPIHYCAPAGYAILKCNNKTFTGTGPCNNVSTVQCTHGIKPVVSTQLLLNGSLAEGEI
IIRSENITNNDKTIIVHLNESVKIECTRPSNKTRTSIRIGPGQAFYATGQVIGDIREAYCNISESKWNETLQRVSKK
LKEYFPHKNITFQPSSGGDLEITTHSFNCGGEFFYCNTSSLFNRTYMANSTDMANSTETNSTRNITIHCRIKQIINM
WQEVGRAMYAPPIAGNITCISNITGLLLTRDYGKNDTETFRPGGGNMKDNWRSELYKYKVVEVKPLGVAPTNARERV
VEREKE**
>CH505w30.12chim.6R.SOSIP.664v4.1G458Y
AENLWVTVYYGVPVWKEAKTTLFCASDAKAYEKKVHNVWATHACVPTDPNPQEMVLKNVTENFNMWKNDMVDQMHED
VISLWDQSLKPCVKLTPLCVTLNCTNATNATASNSSIIEGMKNCSFNITTELRDKREKKNALFYKLDIVQLDGNSSQ
YRLINCNTSVITQACPKVSFDPIPIHYCAPAGYAILKCNNKTFTGTGPCNNVSTVQCTHGIKPVVSTQLLLNGSLAE
GEIIIRSENITNNDKTIIVHLNESVKIECTRPSNKTRTSIRIGPGQWFYATGQVIGDIREAYCNISESKWNETLQRV
SKKLKEYFPHKNITFQPSSGGDLEITTHSFNCGGEFFYCNTSSLFNRTYMANSTDMANSTETNSTRNITIHCRIKQI
INMWQEVGRAMYAPPIAGNITCISNITGLLLTRDYGKNDTETFRPGGGNMKDNWRSELYKYKVVKIEPLGVAPTRCK
RRVVGRRRRRRAVGIGAVFLGFLGAAGSTMGAASMTLTVQARNLLSGIVQQQSNLLRAPEAQQHLLKLTVWGIKQLQ
ARVLAVERYLRDQQLLGIWGCSGKLICCTNVPWNSSWSNRNLSEIWDNMTWLQWDKEISNYTQIIYGLLEESQNQQE
KNEQDLLALD*
>CH505w30.12chim.6R.SOSIP.664G458Y
AENLWVTVYYGVPVWKEAKTTLFCASDAKAYEKEVHNVWATHACVPTDPNPQEMVLKNVTENFNMWKNDMVDQMHED
VISLWDQSLKPCVKLTPLCVTLNCTNATNATASNSSIIEGMKNCSFNITTELRDKREKKNALFYKLDIVQLDGNSSQ
YRLINCNTSVITQACPKVSFDPIPIHYCAPAGYAILKCNNKTFTGTGPCNNVSTVQCTHGIKPVVSTQLLLNGSLAE
GEIIIRSENITNNDKTIIVHLNESVKIECTRPSNKTRTSIRIGPGQAFYATGQVIGDIREAYCNISESKWNETLQRV
SKKLKEYFPHKNITFQPSSGGDLEITTHSFNCGGEFFYCNTSSLFNRTYMANSTDMANSTETNSTRNITIHCRIKQI
INMWQEVGRAMYAPPIAGNITCISNITGLLLTRDYGKNDTETFRPGGGNMKDNWRSELYKYKVVKIEPLGVAPTRCK
RRVVGRRRRRRAVGIGAVFLGFLGAAGSTMGAASMTLTVQARNLLSGIVQQQSNLLRAPEAQQHLLKLTVWGIKQLQ
ARVLAVERYLRDQQLLGIWGCSGKLICCTNVPWNSSWSNRNLSEIWDNMTWLQWDKEISNYTQIIYGLLEESQNQQE
KNEQDLLALD*

Figure 81 cont.

>CH505w30.20gp160G458Y
MWVTVYYGVPVWKEAKTTLFCASDAKAYEKEVHNVWATHACVPTDPNPQEMVLKNVTENFNMWKNDMVDQMHEDVIS
LWDQSLKPCVKLTPLCVTLNCTNATTNATASNSSIIEGMKNCSFNITTELRDKREKKNALFYKLDIVQLDGNSSQYR
LINCNTSVITQACPKVSFDPIPIHYCAPAGYAILKCNNKTFTGTGPCNNVSTVQCTHGIKPVVSTQLLLNGSLAEGE
IIIRSENITNNAKTIIVHLNESVKIECTRPNNKTRTSIRIGPGQAFYATGQVIGDIREAYCNISESKWNETLQRVSK
KLKEYFPHKNITFQPSSGGDLEITTHSFNCGGEFFYCNTSSLFNRTYMANSTDMANSTETNSTRIITIHCRIKQIIN
MWQEVGRAMYAPPIAGNITCISNITGLLLTRDYGKNTRDGGKNNTETFRPGGGNMKDNWRSELYKYKVVEVKPLGVA
PTNARRRVVEREKRAVGMGAVFLGFLGAAGSTMGAASITLTVQARQLLSGIVQQQSNLLKAIEAQQHMLKLTVWGIK
QLQARVLALERYLKDQQLLGMWGCSGKLICTTNVYWNSSWSNKTYGDIWDNMTWMQWEREISNYTEIIYELLEESQN
QQEKNEQDLLALDRWNSLWNWFNITNWLWYIKIFIMIVGGLIGLRIIFAVLSLVNRVRQGYSPLSLQTLIPSPRGPD
RPGGIEEEGGEQDRNRSTRLVSGFLALAWDDLRSLCLFIYHRLRDFILIAARAGELLGRSSLKGLRRGWEALKYLGS
LVQYWGLELKRSAISLLDTLAIAVGEGTDRILEFVLGICRAIRNIPTRIRQGFETALL**
>CH505w30.20gp140cG458Y
MWVTVYYGVPVWKEAKTTLFCASDAKAYEKEVHNVWATHACVPTDPNPQEMVLKNVTENFNMWKNDMVDQMHEDVIS
LWDQSLKPCVKLTPLCVTLNCTNATTNATASNSSIIEGMKNCSFNITTELRDKREKKNALFYKLDIVQLDGNSSQYR
LINCNTSVITQACPKVSFDPIPIHYCAPAGYAILKCNNKTFTGTGPCNNVSTVQCTHGIKPVVSTQLLLNGSLAEGE
IIIRSENITNNAKTIIVHLNESVKIECTRPNNKTRTSIRIGPGQAFYATGQVIGDIREAYCNISESKWNETLQRVSK
KLKEYFPHKNITFQPSSGGDLEITTHSFNCGGEFFYCNTSSLFNRTYMANSTDMANSTETNSTRIITIHCRIKQIIN
MWQEVGRAMYAPPIAGNITCISNITGLLLTRDYGKNTRDGGKNNTETFRPGGGNMKDNWRSELYKYKVVEVKPLGVA
PTNARERVVEREKEAVGMGAVFLGFLGAAGSTMGAASITLTVQARQLLSGIVQQQSNLLKAIEAQQHMLKLTVWGIK
QLQARVLALERYLKDQQLLGMWGCSGKLICTTNVYWNSSWSNKTYGDIWDNMTWMQWEREISNYTEIIYELLEESQN
QQEKNEQDLLALDRWNSLWNWFNITNWLWYIK**
>CH505w30.20gp120G458Y
MWVTVYYGVPVWKEAKTTLFCASDAKAYEKEVHNVWATHACVPTDPNPQEMVLKNVTENFNMWKNDMVDQMHEDVIS
LWDQSLKPCVKLTPLCVTLNCTNATTNATASNSSIIEGMKNCSFNITTELRDKREKKNALFYKLDIVQLDGNSSQYR
LINCNTSVITQACPKVSFDPIPIHYCAPAGYAILKCNNKTFTGTGPCNNVSTVQCTHGIKPVVSTQLLLNGSLAEGE
IIIRSENITNNAKTIIVHLNESVKIECTRPNNKTRTSIRIGPGQAFYATGQVIGDIREAYCNISESKWNETLQRVSK
KLKEYFPHKNITFQPSSGGDLEITTHSFNCGGEFFYCNTSSLFNRTYMANSTDMANSTETNSTRIITIHCRIKQIIN
MWQEVGRAMYAPPIAGNITCISNITGLLLTRDYGKNTRDGGKNNTETFRPGGGNMKDNWRSELYKYKVVEVKPLGVA
PTNARERVVEREKE**
>CH505w30.20chim.6R.SOSIP.664v4.1G458Y
AENLWVTVYYGVPVWKEAKTTLFCASDAKAYEKKVHNVWATHACVPTDPNPQEMVLKNVTENFNMWKNDMVDQMHED
VISLWDQSLKPCVKLTPLCVTLNCTNATTNATASNSSIIEGMKNCSFNITTELRDKREKKNALFYKLDIVQLDGNSS
QYRLINCNTSVITQACPKVSFDPIPIHYCAPAGYAILKCNNKTFTGTGPCNNVSTVQCTHGIKPVVSTQLLLNGSLA
EGEIIIRSENITNNAKTIIVHLNESVKIECTRPNNKTRTSIRIGPGQWFYATGQVIGDIREAYCNISESKWNETLQR
VSKKLKEYFPHKNITFQPSSGGDLEITTHSFNCGGEFFYCNTSSLFNRTYMANSTDMANSTETNSTRIITIHCRIKQ
IINMWQEVGRAMYAPPIAGNITCISNITGLLLTRDYGKNTRDGGKNNTETFRPGGGNMKDNWRSELYKYKVVKIEPL
GVAPTRCKRRVVGRRRRRAVGIGAVFLGFLGAAGSTMGAASMTLTVQARNLLSGIVQQQSNLLRAPEAQQHLLKLT
VWGIKQLQARVLAVERYLPDQQLLGIWGCSGKLICCTNVPWNSSWSNPNLSEIWDNMTWLQWDKEISNYTQIIYGLL
EESQNQQEKNEQDLLALD*
>CH505w30.20chim.6R.SOSIP.664G458Y
AENLWVTVYYGVPVWKEAKTTLFCASDAKAYEKEVHNVWATHACVPTDPNPQEMVLKNVTENFNMWKNDMVDQMHED
VISLWDQSLKPCVKLTPLCVTLNCTNATTNATASNSSIIEGMKNCSFNITTELRDKREKKNALFYKLDIVQLDGNSS
QYRLINCNTSVITQACPKVSFDPIPIHYCAPAGYAILKCNNKTFTGTGPCNNVSTVQCTHGIKPVVSTQLLLNGSLA
EGEIIIRSENITNNAKTIIVHLNESVKIECTRPNNKTRTSIRIGPGQAFYATGQVIGDIREAYCNISESKWNETLQR
VSKKLKEYFPHKNITFQPSSGGDLEITTHSFNCGGEFFYCNTSSLFNRTYMANSTDMANSTETNSTRIITIHCRIKQ
IINMWQEVGRAMYAPPIAGNITCISNITGLLLTRDYGKNTRDGGKNNTETFRPGGGNMKDNWRSELYKYKVVKIEPL
GVAPTRCKPRVVGRRRRRAVGIGAVFLGFLGAAGSTMGAASMTLTVQARNLLSGIVQQQSNLLRAPEAQQHLLKLT
VWGIKQLQARVLAVERYLRDQQLLGIWGCSGKLICCTNVPWNSSWSNRNLSEIWDNMTWLQWDKEISNYTQIIYGLL
EESQNQQEKNEQDLLALD*

Figure 81 cont.

>CH505w136.B18gp160G458Y
MWVTVYYGVPVWKEAKTTLFCASDAKAYEKEVHNVWATHACVPTDPNPQEMVLKNVTENFNMWKNDMVDQMHEDVIS
LWDQSLTPCVKLTPLCVTLNCTDANDTASNSSIIKGMNNSIVGEMKNCSFNITTELRDKPEKKNALFYKLDIVQLDG
NSSEYRLINCNTSVITQACPKVSFDPIPIHYCAPAGYAILKCNNKTFNGTGPCNNVSTVQCTHGIKPVVSTQLLLNG
SLAEGEIIIRSENITDNAKTIIVHLNESVKIECTRPSNNTRTSIRIGPGQAFYATGQVIGDIRKAHCNISESKWNET
LQRVSKKLKEYFPDKNITFQPSSGGDPEITTHSFNCGGEFFYCNTSSLFNRTYMANSTDMANSAETNSTRTITLHCR
IKQIINMWQEVGRAMYAPPIAGNITCISNITGLLLTRDYGNSSTETETFRPGGGNMKDNWRSELYKYKVVEVKPLGV
APTNARRRVVEREKRAVGMGAVFLGFLGAAGSTMGAASITLTVQARQLLSGIVQQQSNLLKAIEAQQHMLRLTVWGI
KQLQARVLALERYLKDQQLLGMWGCSGKLICTTNVYWNSSWSNKTYDDIWDNMTWMQWEGEISNYTNIIYDLLEESQ
NQQEKNEQDLLALDRWNSLWNWFNITNWLWYIKIFIMIVGGLIGLRIIFAVLSLVNRVRQGYSPLSLQTLIPSPRGP
DRPGGIEEEGGEQDRKRSTRLVSGFLALVWDDLRSLCLFLYHRLRDFILIAARAGELLGRSSLKGLRRGWEALKYLG
SLVQYWGLELKRSAISLLDTLAIAVGEGTDRILEFVLGICRAIRNIPTRIRQGFETALL**
>CH505w136.B18gp140cG458Y
MWVTVYYGVPVWKEAKTTLFCASDAKAYEKEVHNVWATHACVPTDPNPQEMVLKNVTENFNMWKNDMVDQMHEDVIS
LWDQSLTPCVKLTPLCVTLNCTDANDTASNSSIIKGMNNSIVGEMKNCSFNITTELRDKREKKNALFYKLDIVQLDG
NSSEYRLINCNTSVITQACPKVSFDPIPIHYCAPAGYAILKCNNKTFNGTGPCNNVSTVQCTHGIKPVVSTQLLLNG
SLAEGEIIIRSENITDNAKTIIVHLNESVKIECTRPSNNTRTSIRIGPGQAFYATGQVIGDIRKAHCNISESKWNET
LQRVSKKLKEYFPDKNITFQPSSGGDPEITTHSFNCGGEFFYCNTSSLFNRTYMANSTDMANSAETNSTRTITLHCR
IKQIINMWQEVGRAMYAPPIAGNITCISNITGLLLTRDYGNSSTETETFRPGGGNMKDNWRSELYKYKVVEVKPLGV
APTNARERVVEREKEAVGMGAVFLGFLGAAGSTMGAASITLTVQARQLLSGIVQQQSNLLKAIEAQQHMLRLTVWGI
KQLQARVLALERYLKDQQLLGMWGCSGKLICTTNVYWNSSWSNKTYDDIWDNMTWMQWEGEISNYTNIIYDLLEESQ
NQQEKNEQDLLALDRWNSLWNWFNITNWLWYIK**
>CH505w136.B18gp120G458Y
MWVTVYYGVPVWKEAKTTLFCASDAKAYEKEVHNVWATHACVPTDPNPQEMVLKNVTENFNMWKNDMVDQMHEDVIS
LWDQSLTPCVKLTPLCVTLNCTDANDTASNSSIIKGMNNSIVGEMKNCSFNITTELRDKPEKKNALFYKLDIVQLDG
NSSEYRLINCNTSVITQACPKVSFDPIPIHYCAPAGYAILKCNNKTFNGTGPCNNVSTVQCTHGIKPVVSTQLLLNG
SLAEGEIIIRSENITDNAKTIIVHLNESVKIECTRPSNNTRTSIRIGPGQAFYATGQVIGDIRKAHCNISESKWNET
LQRVSKKLKEYFPDKNITFQPSSGGDPEITTHSFNCGGEFFYCNTSSLFNRTYMANSTDMANSAETNSTRTITLHCR
IKQIINMWQEVGRAMYAPPIAGNITCISNITGLLLTRDYGNSSTETETFRPGGGNMKDNWRSELYKYKVVEVKPLGV
APTNARERVVEREKE**
>CH505w136.B18chim.6R.SOSIP.664v4.1G458Y
AENLWVTVYYGVPVWKEAKTTLFCASDAKAYEKKVHNVWATHACVPTDPNPQEMVLKNVTENFNMWKNDMVDQMHED
VISLWDQSLTPCVKLTPLCVTLNCTDANDTASNSSIIKGMNNSIVGEMKNCSFNITTELRDKPEKKNALFYKLDIVQ
LDGNSSEYRLINCNTSVITQACPKVSFDPIPIHYCAPAGYAILKCNNKTFNGTGPCNNVSTVQCTHGIKPVVSTQLL
LNGSLAEGEIIIRSENITDNAKTIIVHLNESVKIECTRPSNNTRTSIRIGPGQWFYATGQVIGDIRKAHCNISESKW
NETLQRVSKKLKEYFPDKNITFQPSSGGDPEITTHSFNCGGEFFYCNTSSLFNRTYMANSTDMANSAETNSTRTITL
HCRIKQIINMWQEVGRAMYAPPIAGNITCISNITGLLLTRDYGNSSTETETFRPGGGNMKDNWRSELYKYKVVKIEP
LGVAPTRCKRRVVGRRRRRRAVGIGAVFLGFLGAAGSTMGAASMTLTVQARNLLSGIVQQQSNLLRAPEAQQHLLKL
TVWGIKQLQARVLAVERYLRDQQLLGIWGCSGKLICCTNVPWNSSWSNRNLSEIWDNMTWLQWDKEISNYTQIIYGL
LEESQNQQEKNEQDLLALD*
>CH505w136.B18chim.6R.SOSIP.664G458Y
MGSLQPLATLYLLGMLVASVLAAENLWVTVYYGVPVWKEAKTTLFCASDAKAYEKEVHNVWATHACVPTDPNPQEMV
LKNVTENFNMWKNDMVDQMHEDVISLWDQSLTPCVKLTPLCVTLNCTDANDTASNSSIIKGMNNSIVGEMKNCSFNI
TTELRDKPEKKNALFYKLDIVQLDGNSSEYRLINCNTSVITQACPKVSFDPIPIHYCAPAGYAILKCNNKTFNGTGP
CNNVSTVQCTHGIKPVVSTQLLLNGSLAEGEIIIRSENITDNAKTIIVHLNESVKIECTRPSNNTRTSIRIGPGQAF
YATGQVIGDIRKAHCNISESKWNETLQRVSKKLKEYFPDKNITFQPSSGGDPEITTHSFNCGGEFFYCNTSSLFNRT
YMANSTDMANSAETNSTRTITLHCRIKQIINMWQEVGRAMYAPPIAGNITCISNITGLLLTRDYGNSSTETETFRPG
GGNMKDNWRSELYKYKVVKIEPLGVAPTRCKRRVVGPRRRRRAVGIGAVFLGFLGAAGSTMGAASMTLTVQARNLLS
GIVQQQSNLLRAPEAQQHLLKLTVWGIKQLQARVLAVERYLRDQQLLGIWGCSGKLICCTNVPWNSSWSNRNLSEIW
DNMTWLQWDKEISNYTQIIYGLLEESQNQQEKNEQDLLALD*

Figure 81 cont.

```
>CH505TFgp160G458Y
MWVTVYYGVPVWKEAKTTLFCASDAKAYEKEVHNVWATHACVPTDPNPQEMVLKNVTENFNMWKNDMVDQMHEDVIS
LWDQSLKPCVKLTPLCVTLNCTNATASNSSIIEGMKNCSFNITTELRDKREKKNALFYKLDIVQLDGNSSQYRLINC
NTSVITQACPKVSFDPIPIHYCAPAGYAILKCNNKTFTGTGPCNNVSTVQCTHGIKPVVSTQLLLNGSLAEGEIIIR
SENITNNVKTIIVHLNESVKIECTRPNNKTRTSIRIGPGQAFYATGQVIGDIREAYCNINESKWNETLQRVSKKLKE
YFPHKNITFQPSSGGDLEITTHSFNCGGEFFYCNTSSLFNRTYMANSTDMANSTETNSTRTITIHCRIKQIINMWQE
VGRAMYAPPIAGNITCISNITGLLLTRDYGKNNTETFRPGGGNMKDNWRSELYKYKVVEVKPLGVAPTNARRRVVER
EKRAVGMGAVFLGFLGAAGSTMGAASITLTVQARQLLSGIVQQQSNLLKAIEAQQHMLKLTVWGIKQLQARVLALER
YLKDQQLLGMWGCSGKLICTTNVYWNSSWSNKTYGDIWDNMTWMQWEREISNYTEIIYELLEESQNQQEKNEQDLLA
LDRWNSLWNWFNITNWLWYIKIFIMIVGGLIGLRIIFAVLSLVNRVRQGYSPLSLQTLIPSPRGPDRPGGIEEEGGE
QDRNRSTRLVSGFLALVWDDLRSLCLFIYHRLRDFILIAARAGELLGRSSLKGLRRGWEALKYLGSLVQYWGLELKR
SAISLLDTLAIAVGEGTDRILEFVLGICRAIRNIPTRIRQGFETALL*
>CH505TFgp140cG458Y
MWVTVYYGVPVWKEAKTTLFCASDAKAYEKEVHNVWATHACVPTDPNPQEMVLKNVTENFNMWKNDMVDQMHEDVIS
LWDQSLKPCVKLTPLCVTLNCTNATASNSSIIEGMKNCSFNITTELRDKREKKNALFYKLDIVQLDGNSSQYRLINC
NTSVITQACPKVSFDPIPIHYCAPAGYAILKCNNKTFTGTGPCNNVSTVQCTHGIKPVVSTQLLLNGSLAEGEIIIR
SENITNNVKTIIVHLNESVKIECTRPNNKTRTSIRIGPGQAFYATGQVIGDIREAYCNINESKWNETLQRVSKKLKE
YFPHKNITFQPSSGGDLEITTHSFNCGGEFFYCNTSSLFNRTYMANSTDMANSTETNSTRTITIHCRIKQIINMWQE
VGRAMYAPPIAGNITCISNITGLLLTRDYGKNNTETFRPGGGNMKDNWRSELYKYKVVEVKPLGVAPTNARERVVER
EKEAVGMGAVFLGFLGAAGSTMGAASITLTVQARQLLSGIVQQQSNLLKAIEAQQHMLKLTVWGIKQLQARVLALER
YLKDQQLLGMWGCSGKLICTTNVYWNSSWSNKTYGDIWDNMTWMQWEREISNYTEIIYELLEESQNQQEKNEQDLLA
LDRWNSLWNWFNITNWLWYIK*
>CH505TFgp120G458Y
MWVTVYYGVPVWKEAKTTLFCASDAKAYEKEVHNVWATHACVPTDPNPQEMVLKNVTENFNMWKNDMVDQMHEDVIS
LWDQSLKPCVKLTPLCVTLNCTNATASNSSIIEGMKNCSFNITTELRDKREKKNALFYKLDIVQLDGNSSQYRLINC
NTSVITQACPKVSFDPIPIHYCAPAGYAILKCNNKTFTGTGPCNNVSTVQCTHGIKPVVSTQLLLNGSLAEGEIIIR
SENITNNVKTIIVHLNESVKIECTRPNNKTRTSIRIGPGQAFYATGQVIGDIREAYCNINESKWNETLQRVSKKLKE
YFPHKNITFQPSSGGDLEITTHSFNCGGEFFYCNTSSLFNRTYMANSTDMANSTETNSTRTITIHCRIKQIINMWQE
VGRAMYAPPIAGNITCISNITGLLLTRDYGKNNTETFRPGGGNMKDNWRSELYKYKVVEVKPLGVAPTNARERVVER
EKE*
>CH505TFchimSOSIP.664.v4.1G458Y
AENLWVTVYYGVPVWKEAKTTLFCASDAKAYEKKVHNVWATHACVPTDPNPQEMVLKNVTENFNMWKNDMVDQMHED
VISLWDQSLKPCVKLTPLCVTLNCTNATASNSSIIEGMKNCSFNITTELRDKREKKNALFYKLDIVQLDGNSSQYRL
INCNTSVITQACPKVSFDPIPIHYCAPAGYAILKCNNKTFTGTGPCNNVSTVQCTHGIKPVVSTQLLLNGSLAEGEI
IIRSENITNNVKTIIVHLNESVKIECTRPNNKTRTSIRIGPGQWFYATGQVIGDIREAYCNINESKWNETLQRVSKK
LKEYFPHKNITFQPSSGGDLEITTHSFNCGGEFFYCNTSSLFNRTYMANSTDMANSTETNSTRTITIHCRIKQIINM
WQEVGRAMYAPPIAGNITCISNITGLLLTRDYGKNNTETFRPGGGNMKDNWRSELYKYKVVKIEPLGVAPTRCKRRV
VGRRRRRRAVGIGAVFLGFLGAAGSTMGAASMTLTVQARNLLSGIVQQQSNLLPAPEAQQHLLKLTVWGIKQLQARV
LAVERYLRDQQLLGIWGCSGKLICCTNVPWNSSWSNRNLSEIWDNMTWLQWDKEISNYTQIIYGLLEESQNQQEKNE
QDLLALD**
>CH505TFchimSOSIP.664G458Y
AENLWVTVYYGVPVWKEAKTTLFCASDAKAYEKEVHNVWATHACVPTDPNPQEMVLKNVTENFNMWKNDMVDQMHED
VISLWDQSLKPCVKLTPLCVTLNCTNATASNSSIIEGMKNCSFNITTELRDKREKKNALFYKLDIVQLDGNSSQYRL
INCNTSVITQACPKVSFDPIPIHYCAPAGYAILKCNNKTFTGTGPCNNVSTVQCTHGIKPVVSTQLLLNGSLAEGEI
IIRSENITNNVKTIIVHLNESVKIECTRPNNKTRTSIRIGPGQAFYATGQVIGDIREAYCNINESKWNETLQRVSKK
LKEYFPHKNITFQPSSGGDLEITTHSFNCGGEFFYCNTSSLFNRTYMANSTDMANSTETNSTRTITIHCRIKQIINM
WQEVGRAMYAPPIAGNITCISNITGLLLTRDYGKNNTETFRPGGGNMKDNWRSELYKYKVVKIEPLGVAPTRCKRRV
VGRRRRRPAVGIGAVFLGFLGAAGSTMGAASMTLTVQARNLLSGIVQQQSNLLRAPEAQQHLLKLTVWGIKQLQARV
LAVERYLRDQQLLGIWGCSGKLICCTNVPWNSSWSNRNLSEIWDNMTWLQWDKEISNYTQIIYGLLEESQNQQEKNE
QDLLALD**
```

Figure 81 cont.

```
>CH505week53.16gp160G458Y
MWVTVYYGVPVWKEAKTTLFCASDAKAYEKEVHNVWATHACVPTDPNPQEMVLKNVTENFNMWKNDMVDQMHEDVIS
LWDQSLKPCVKLTPLCVTLNCTNANATASNSSIIEGMNSSIIEGMKNCSFNITTELRDKPEKKNALFYKLDIVQLDG
NSSQYRLINCNTSVITQACPKVSFDPIPIHYCAPAGYAILKCNNKTFNGTGPCNNVSTVQCTHGIKPVVSTQLLLNG
SLAEGEIIIRSENITDNGKTIIVHLNESVKIECTRPSNNTRTSIRIGPGQAFYATGQVIGDIREAHCNISESKWNET
LQRVSEKLKEYFPHKNITFQPSSGGDLEITTHSFNCGGEFFYCNTSSLFNRTYMATSTDMANSTETNSTRIITIRCR
IKQIINMWQEVGRAMYAPPIAGNITCISNITGLLLTRDYGKNNTETFETFRPGGGNMKDNWRSELYKYKVVEVKPLG
VAPTNARRRVVEREKRAVGMGAVFLGFLGAAGSTMGAASITLTVQARQLLSGIVQQQSNLLKAIEAQQHMLKLTVWG
IKQLQARVLALERYLKDQQLLGMWGCSGKLICTTNVYWNSSWSNKTYGDIWDNMTWMQWEREISNYTEIIYELLEES
QNQQEKNEQDLLALDRWNSLWNWFNITNWLWYIKIFIMIVGGLIGLRIIFAVLSLVNRVRQGYSPLSLQTLIPSPRG
PDRPGGIEEEGGEQDRNRSTRLVSGFLALAWDDLRSLCLFIYHRLRDFILIAARAGELLGRSSLKGLRRGWEALKYL
GSLVQYWGLELKRSAISLLDTLAIAVGEGTDRILEFVLGICRAIRNIPTRIRQGFETALL*
>CH505week53.16gp140cG458Y
MWVTVYYGVPVWKEAKTTLFCASDAKAYEKEVHNVWATHACVPTDPNPQEMVLKNVTENFNMWKNDMVDQMHEDVIS
LWDQSLKPCVKLTPLCVTLNCTNANATASNSSIIEGMNSSIIEGMKNCSFNITTELRDKREKKNALFYKLDIVQLDG
NSSQYRLINCNTSVITQACPKVSFDPIPIHYCAPAGYAILKCNNKTFNGTGPCNNVSTVQCTHGIKPVVSTQLLLNG
SLAEGEIIIRSENITDNGKTIIVHLNESVKIECTRPSNNTRTSIRIGPGQAFYATGQVIGDIREAHCNISESKWNET
LQRVSEKLKEYFPHKNITFQPSSGGDLEITTHSFNCGGEFFYCNTSSLFNRTYMATSTDMANSTETNSTRIITIRCR
IKQIINMWQEVGRAMYAPPIAGNITCISNITGLLLTRDYGKNNTETFETFRPGGGNMKDNWRSELYKYKVVEVKPLG
VAPTNARERVVEREKEAVGMGAVFLGFLGAAGSTMGAASITLTVQARQLLSGIVQQQSNLLKAIEAQQHMLKLTVWG
IKQLQARVLALERYLKDQQLLGMWGCSGKLICTTNVYWNSSWSNKTYGDIWDNMTWMQWEREISNYTEIIYELLEES
QNQQEKNEQDLLALDRWNSLWNWFNITNWLWYIK*
>CH505week53.16gp120G458Y
MWVTVYYGVPVWKEAKTTLFCASDAKAYEKEVHNVWATHACVPTDPNPQEMVLKNVTENFNMWKNDMVDQMHEDVIS
LWDQSLKPCVKLTPLCVTLNCTNANATASNSSIIEGMNSSIIEGMKNCSFNITTELRDKPEKKNALFYKLDIVQLDG
NSSQYRLINCNTSVITQACPKVSFDPIPIHYCAPAGYAILKCNNKTFNGTGPCNNVSTVQCTHGIKPVVSTQLLLNG
SLAEGEIIIRSENITDNGKTIIVHLNESVKIECTRPSNNTRTSIRIGPGQAFYATGQVIGDIREAHCNISESKWNET
LQRVSEKLKEYFPHKNITFQPSSGGDLEITTHSFNCGGEFFYCNTSSLFNRTYMATSTDMANSTETNSTRIITIRCR
IKQIINMWQEVGRAMYAPPIAGNITCISNITGLLLTRDYGKNNTETFETFRPGGGNMKDNWRSELYKYKVVEVKPLG
VAPTNARERVVEREKE*
>CH505w053.16.chim.6R.SOSIP.664v4.1G458Y
AENLWVTVYYGVPVWKEAKTTLFCASDAKAYEKKVHNVWATHACVPTDPNPQEMVLKNVTENFNMWKNDMVDQMHED
VISLWDQSLKPCVKLTPLCVTLNCTNANATASNSSIIEGMNSSIIEGMKNCSFNITTELRDKPEKKNALFYKLDIVQ
LDGNSSQYRLINCNTSVITQACPKVSFDPIPIHYCAPAGYAILKCNNKTFNGTGPCNNVSTVQCTHGIKPVVSTQLL
LNGSLAEGEIIIRSENITDNGKTIIVHLNESVKIECTRPSNNTRTSIRIGPGQWFYATGQVIGDIREAHCNISESKW
NETLQRVSEKLKEYFPHKNITFQPSSGGDLEITTHSFNCGGEFFYCNTSSLFNRTYMATSTDMANSTETNSTRIITI
RCRIKQIINMWQEVGRAMYAPPIAGNITCISNITGLLLTRDYGKNNTETFETFRPGGGNMKDNWRSELYKYKVVKIE
PLGVAPTRCKRRVVGRRRRRRAVGIGAVFLGFLGAAGSTMGAASMTLTVQARNLLSGIVQQQSNLLRAPEAQQHLLK
LTVWGIKQLQARVLAVERYLPDQQLLGIWGCSGKLICCTNVPWNSSWSNRNLSEIWDNMTWLQWDKEISNYTQIIYG
LLEESQNQQEKNEQDLLALD*
>CH505w053.16.chim.6R.SOSIP.664G458Y
AENLWVTVYYGVPVWKEAKTTLFCASDAKAYEKEVHNVWATHACVPTDPNPQEMVLKNVTENFNMWKNDMVDQMHED
VISLWDQSLKPCVKLTPLCVTLNCTNANATASNSSIIEGMNSSIIEGMKNCSFNITTELRDKREKKNALFYKLDIVQ
LDGNSSQYRLINCNTSVITQACPKVSFDPIPIHYCAPAGYAILKCNNKTFNGTGPCNNVSTVQCTHGIKPVVSTQLL
LNGSLAEGEIIIRSENITDNGKTIIVHLNESVKIECTRPSNNTRTSIRIGPGQAFYATGQVIGDIREAHCNISESKW
NETLQRVSEKLKEYFPHKNITFQPSSGGDLEITTHSFNCGGEFFYCNTSSLFNRTYMATSTDMANSTETNSTRIITI
RCRIKQIINMWQEVGRAMYAPPIAGNITCISNITGLLLTRDYGKNNTETFETFRPGGGNMKDNWRSELYKYKVVKIE
PLGVAPTRCKRRVVGRRRRRRAVGIGAVFLGFLGAAGSTMGAASMTLTVQARNLLSGIVQQQSNLLRAPEAQQHLLK
LTVWGIKQLQARVLAVERYLRDQQLLGIWGCSGKLICCTNVPWNSSWSNRNLSEIWDNMTWLQWDKEISNYTQIIYG
LLEESQNQQEKNEQDLLALD*
```

Figure 81 cont.

```
                                          1                                                  50
        CH505.w30.12gp120G458Y      (1)  ---
        CH505.w30.12gp140cG458Y     (1)  ---
        CH505.w30.12gp160G458Y      (1)  ---
   CH505w30.12chim.6R.SOSIP.664G458Y (1)  AEN
 CH505w30.12chim.6R.SOSIP.664v4.1G458Y (1) AEN
                              Consensus (1)  MWVTVYYGVPVWKEAKTTLFCASDAKAYEKEVHNVWATHACVPTDPN
                                          51                                                 100
        CH505.w30.12gp120G458Y      (48)
        CH505.w30.12gp140cG458Y     (48)
        CH505.w30.12gp160G458Y      (48)
   CH505w30.12chim.6R.SOSIP.664G458Y (51)
 CH505w30.12chim.6R.SOSIP.664v4.1G458Y (51)
                              Consensus (51) PQEMVLKNVTENFNMWKNDMVDQMHEDVISLWDQSLKPCVKLTPLCVTLN
                                          101                                                150
        CH505.w30.12gp120G458Y      (98)
        CH505.w30.12gp140cG458Y     (98)
        CH505.w30.12gp160G458Y      (98)
   CH505w30.12chim.6R.SOSIP.664G458Y (101)
 CH505w30.12chim.6R.SOSIP.664v4.1G458Y (101)
                              Consensus (101) CTNATNATASNSSIIEGMKNCSFNITTELRDKREKKNALFYKLDIVQLDG
                                          151                                                200
        CH505.w30.12gp120G458Y      (148)
        CH505.w30.12gp140cG458Y     (148)
        CH505.w30.12gp160G458Y      (148)
   CH505w30.12chim.6R.SOSIP.664G458Y (151)
 CH505w30.12chim.6R.SOSIP.664v4.1G458Y (151)
                              Consensus (151) NSSQYRLINCNTSVITQACPKVSFDPIPIHYCAPAGYAILKCNNKTFTGT
                                          201                                                250
        CH505.w30.12gp120G458Y      (198)
        CH505.w30.12gp140cG458Y     (198)
        CH505.w30.12gp160G458Y      (198)
   CH505w30.12chim.6R.SOSIP.664G458Y (201)
 CH505w30.12chim.6R.SOSIP.664v4.1G458Y (201)
                              Consensus (201) GPCNNVSTVQCTHGIKPVVSTQLLLNGSLAEGEIIIPSENITNNDKTIIV
                                          251                                                300
        CH505.w30.12gp120G458Y      (248)
        CH505.w30.12gp140cG458Y     (248)
        CH505.w30.12gp160G458Y      (248)
   CH505w30.12chim.6R.SOSIP.664G458Y (251)
 CH505w30.12chim.6R.SOSIP.664v4.1G458Y (251)
                              Consensus (251) HLNESVKIECTRPSNKTRTSIRIGPGQAFYATGQVIGDIREAYCNISESK
                                          301                                                350
        CH505.w30.12gp120G458Y      (298)
        CH505.w30.12gp140cG458Y     (298)
        CH505.w30.12gp160G458Y      (298)
   CH505w30.12chim.6R.SOSIP.664G458Y (301)
 CH505w30.12chim.6R.SOSIP.664v4.1G458Y (301)
                              Consensus (301) WNETLQPVSKKLKEYFPHKNITFQPSSGGDLEITTHSFNCGGEFFYCNTS
                                          351                                                400
        CH505.w30.12gp120G458Y      (348)
        CH505.w30.12gp140cG458Y     (348)
        CH505.w30.12gp160G458Y      (348)
   CH505w30.12chim.6R.SOSIP.664G458Y (351)
 CH505w30.12chim.6R.SOSIP.664v4.1G458Y (351)
                              Consensus (351) SLFNRTYMANSTDMANSTETNSTPNITIHCRIKQIINMWQEVGRAMYAPP
                                          401                                                450
        CH505.w30.12gp120G458Y      (398)
        CH505.w30.12gp140cG458Y     (398)
        CH505.w30.12gp160G458Y      (398)
   CH505w30.12chim.6R.SOSIP.664G458Y (401)
 CH505w30.12chim.6R.SOSIP.664v4.1G458Y (401)
                              Consensus (401) IAGNITCISNITGLLLTRDYGKNDTETFRPGGGNMKDNWRSELYKYKVVE
```

Figure 81 cont.

```
                CH505.w30.12gp120G458Y  (448)         451                                    500
                CH505.w30.12gp140cG458Y  (448)
                CH505.w30.12gp160G458Y   (448)
        CH505w30.12chim.6R.SOSIP.664G458Y     (451)
    CH505w30.12chim.6R.SOSIP.664v4.1G458Y     (451)
                              Consensus  (451)  VKPLGVAPTNARRRVVEREKR  AVGIGAVFLGFLGAAGSTMGAASITLT
                                                 501                                    550
                CH505.w30.12gp120G458Y  (469)
                CH505.w30.12gp140cG458Y  (496)
                CH505.w30.12gp160G458Y   (496)
        CH505w30.12chim.6R.SOSIP.664G458Y     (501)
    CH505w30.12chim.6R.SOSIP.664v4.1G458Y     (501)
                              Consensus  (501)  VQARNLLSGIVQQQSNLLKA  EAQQHLLKLTVWGIKQLQAPVLALERYLK
                                                 551                                    600
                CH505.w30.12gp120G458Y  (469)
                CH505.w30.12gp140cG458Y  (546)
                CH505.w30.12gp160G458Y   (546)
        CH505w30.12chim.6R.SOSIP.664G458Y     (551)
    CH505w30.12chim.6R.SOSIP.664v4.1G458Y     (551)
                              Consensus  (551)  DQQLLGIWGCSGKLIC TNV WNSSWSNK  DIWDNMTWLQWDKEISNY
                                                 601                                    650
                CH505.w30.12gp120G458Y  (469)
                CH505.w30.12gp140cG458Y  (596)            RWNSLWNWFNITNWLWYIK-----
                CH505.w30.12gp160G458Y   (596)            RWNSLWNWFNITNWLWYIKIFIMI
        CH505w30.12chim.6R.SOSIP.664G458Y     (601)
    CH505w30.12chim.6R.SOSIP.664v4.1G458Y     (601)
                              Consensus  (601)  T IIY LLEESQNQQEKNEQDLLALD
                                                 651                                    700
                CH505.w30.12gp120G458Y  (469)
                CH505.w30.12gp140cG458Y  (641)
                CH505.w30.12gp160G458Y   (646)  VGGLIGLRIIFAVLSLVNRVRQGYSPLSLQTLIPSPRGPDRPGGIEEEGG
        CH505w30.12chim.6R.SOSIP.664G458Y     (627)
    CH505w30.12chim.6R.SOSIP.664v4.1G458Y     (627)
                              Consensus  (651)
                                                 701                                    750
                CH505.w30.12gp120G458Y  (469)
                CH505.w30.12gp140cG458Y  (641)
                CH505.w30.12gp160G458Y   (696)  EQDRNRSTRLVSGFLALVWDDLRSLCLFIYHRLRDFILIAARAGELLGRS
        CH505w30.12chim.6R.SOSIP.664G458Y     (627)
    CH505w30.12chim.6R.SOSIP.664v4.1G458Y     (627)
                              Consensus  (701)
                                                 751                                    800
                CH505.w30.12gp120G458Y  (469)
                CH505.w30.12gp140cG458Y  (641)
                CH505.w30.12gp160G458Y   (746)  SLKGLRRGWEALKYLGSLVQYWGLELKRSAISLLDTLAIAVGEGTDRILE
        CH505w30.12chim.6R.SOSIP.664G458Y     (627)
    CH505w30.12chim.6R.SOSIP.664v4.1G458Y     (627)
                              Consensus  (751)
                                                 801              827
                CH505.w30.12gp120G458Y  (469)
                CH505.w30.12gp140cG458Y  (641)
                CH505.w30.12gp160G458Y   (796)  FILGICRAIRNIPTPIRQGFETALL--
        CH505w30.12chim.6R.SOSIP.664G458Y     (627)
    CH505w30.12chim.6R.SOSIP.664v4.1G458Y     (627)
                              Consensus  (801)
```

Figure 81 cont.

```
                                              1                                                50
CH505w136.B18chim.6R.SOSIP.664G458Y    (1)   MGSLQPLATLYLLGMLVASVLAAEN
CH505w136.B18chim.6R.SOSIP.664v4.1G458Y (1)  ------------------------AEN
           CH505w136.B18gp120G458Y    (1)   ---------------------------
           CH505w136.B18gp140cG458Y   (1)   ---------------------------
           CH505w136.B18gp160G458Y    (1)   ---------------------------
                            Consensus (1)                            MWVTVYYGVPVWKEAKTTLPCASDA
                                              51                                               100
CH505w136.B18chim.6R.SOSIP.664G458Y    (51)
CH505w136.B18chim.6P.SOSIP.664v4.1G458Y (29)
           CH505w136.B18gp120G458Y    (26)
           CH505w136.B18gp140cG458Y   (26)
           CH505w136.B18gp160G458Y    (26)
                            Consensus (51)  KAYEKEVHNVWATHACVPTDPNPQEMVLKNVTENFNMWKNDMVDQMHEDV
                                              101                                              150
CH505w136.B18chim.6R.SOSIP.664G458Y    (101)
CH505w136.B18chim.6P.SOSIP.664v4.1G458Y (79)
           CH505w136.B18gp120G458Y    (76)
           CH505w136.B18gp140cG458Y   (76)
           CH505w136.B18gp160G458Y    (76)
                            Consensus (101) ISLWDQSLTPCVKLTPLCVTLNCTDANDTASRSSIIKGMNNSIVGEMKNC
                                              151                                              200
CH505w136.B18chim.6R.SOSIP.664G458Y    (151)
CH505w136.B18chim.6P.SOSIP.664v4.1G458Y (129)
           CH505w136.B18gp120G458Y    (126)
           CH505w136.B18gp140cG458Y   (126)
           CH505w136.B18gp160G458Y    (126)
                            Consensus (151) SFNITTELRDKREKKNALFYKLDIVQLDGNSSEYRLINCNTSVITQACPK
                                              201                                              250
CH505w136.B18chim.6R.SOSIP.664G458Y    (201)
CH505w136.B18chim.6R.SOSIP.664v4.1G458Y (179)
           CH505w136.B18gp120G458Y    (176)
           CH505w136.B18gp140cG458Y   (176)
           CH505w136.B18gp160G458Y    (176)
                            Consensus (201) VSFDPIPIHYCAPAGYAILKCNNKTFNGTGPCNNVSTVQCTHGIKPVVST
                                              251                                              300
CH505w136.B18chim.6P.SOSIP.664G458Y    (251)
CH505w136.B18chim.6R.SOSIP.664v4.1G458Y (229)
           CH505w136.B18gp120G458Y    (226)
           CH505w136.B18gp140cG458Y   (226)
           CH505w136.B18gp160G458Y    (226)
                            Consensus (251) QLLLNGSLAEGEIIIRSENITDNAKTIIVHLNESVKIECTRPSNNTRTSI
                                              301                                              350
CH505w136.B18chim.6R.SOSIP.664G458Y    (301)
CH505w136.B18chim.6R.SOSIP.664v4.1G458Y (279)
           CH505w136.B18gp120G458Y    (276)
           CH505w136.B18gp140cG458Y   (276)
           CH505w136.B18gp160G458Y    (276)
                            Consensus (301) RIGPGQAFYATGQVIGDIPKAHCNISESKWNETLQRVSKKLKEYFPDKNI
                                              351                                              400
CH505w136.B18chim.6R.SOSIP.664G458Y    (351)
CH505w136.B18chim.6R.SOSIP.664v4.1G458Y (329)
           CH505w136.B18gp120G458Y    (326)
           CH505w136.B18gp140cG458Y   (326)
           CH505w136.B18gp160G458Y    (326)
                            Consensus (351) TFQPSSGGDPEITTHSFNCGGEFFYCNTSSLFNRTYMANSTDMANSAETN
                                              401                                              450
CH505w136.B18chim.6R.SOSIP.664G458Y    (401)
CH505w136.B18chim.6R.SOSIP.664v4.1G458Y (379)
           CH505w136.B18gp120G458Y    (376)
           CH505w136.B18gp140cG458Y   (376)
           CH505w136.B18gp160G458Y    (376)
                            Consensus (401) STRTITLHCRIKQIINMWQEVGRAMYAPPIAGNITCISNITGLLLTRDYG
```

Figure 81 cont.

```
                                              451                                                  500
CH505w136.B18chim.6R.SOSIP.664G458Y    (451)  NSSTETETFRPGGGNMKDNWRSELYKYKVVEVKPLGVAPTRAKRRVVERE P
CH505w136.B18chim.6R.SOSIP.664v4.1G458Y (429) NSSTETETFRPGGGNMKDNWRSELYKYKVVEVKPLGVAPTRAKRRVVGRE R
CH505w136.B18gp120G458Y                (426)  NSSTETETFRPGGGNMKDNWRSELYKYKVVEVKPLGVAPTKAKRR
CH505w136.B18gp140cG458Y               (426)  NSSTETETFRPGGGNMKDNWRSELYKYKVVEVKPLGVAPTKAKRRVVERE V
CH505w136.B18gp160G458Y                (426)  NSSTETETFRPGGGNMKDNWRSELYKYKVVEVKPLGVAPTKAKRRVVERE
                              Consensus (451) NSSTETETFRPGGGNMKDNWRSELYKYKVVEVKPLGVAPTRARRRVVERE
                                              501                                                  550
CH505w136.B18chim.6R.SOSIP.664G458Y    (501)  KR  AVGIGAVFLGFLGAAGSTMGAASITLTVQARNLLSGIVQQQSNLLK
CH505w136.B18chim.6P.SOSIP.664v4.1G458Y (479) KR  AVGIGAVFLGFLGAAGSTMGAASITLTVQARNLLSGIVQQQSNLLK
CH505w136.B18gp120G458Y                (476)  E---
CH505w136.B18gp140cG458Y               (476)  EK--
CH505w136.B18gp160G458Y                (476)  EK--
                              Consensus (501) KR  AVGIGAVFLGFLGAAGSTMGAASITLTVQARNLLSGIVQQQSNLLK
                                              551                                                  600
CH505w136.B18chim.6R.SOSIP.664G458Y    (551)  A EAQQHLLKLTVWGIKQLQARVLALERYLKDQQLLGIWGCSGKLIC  TN
CH505w136.B18chim.6P.SOSIP.664v4.1G458Y (529) A EAQQHLLKLTVWGIKQLQARVLALERYLKDQQLLGIWGCSGKLIC  TN
CH505w136.B18gp120G458Y                (478)  ----
CH505w136.B18gp140cG458Y               (524)  K  I
CH505w136.B18gp160G458Y                (524)  K  I
                              Consensus (551) A EAQQHLLKLTVWGIKQLQARVLALERYLKDQQLLGIWGCSGKLIC  TN
                                              601                                                  650
CH505w136.B18chim.6R.SOSIP.664G458Y    (601)  V WNSSWSNK   DIWDNMTWLQWD EISNYTNIIY LLEESQNQQEKNE
CH505w136.B18chim.6R.SOSIP.664v4.1G458Y (579) V WNSSWSNK   DIWDNMTWLQWD EISNYTNIIY LLEESQNQQEKNE
CH505w136.B18gp120G458Y                (478)  --------
CH505w136.B18gp140cG458Y               (574)  KY    TYD
CH505w136.B18gp160G458Y                (574)  KY    TYD
                              Consensus (601) V WNSSWSNK   DIWDNMTWLQWD EISNYTNIIY LLEESQNQQEKNE
                                              651                                                  700
CH505w136.B18chim.6R.SOSIP.664G458Y    (651)  QDLLALD
CH505w136.B18chim.6R.SOSIP.664v4.1G458Y (629) QDLLALD
CH505w136.B18gp120G458Y                (478)  -----------------
CH505w136.B18gp140cG458Y               (624)  QDLLALDRWNSLWNWFNITNWLWYIK-----------------
CH505w136.B18gp160G458Y                (624)  QDLLALDPWNSLWNWFNITNWLWYIKIFIMIVGGLIGLRIIFAVLSLVNR
                              Consensus (651) QDLLALD
                                              701                                                  750
CH505w136.B18chim.6R.SOSIP.664G458Y    (658)  ------
CH505w136.B18chim.6R.SOSIP.664v4.1G458Y (636) ------
CH505w136.B18gp120G458Y                (478)  ------
CH505w136.B18gp140cG458Y               (650)  ------
CH505w136.B18gp160G458Y                (674)  VRQGYSPLSLQTLIPSPRGPDPPGSIEEEGGEQDRKRSTRLVSGFLALVW
                              Consensus (701)
                                              751                                                  800
CH505w136.B18chim.6R.SOSIP.664G458Y    (658)  ------
CH505w136.B18chim.6R.SOSIP.664v4.1G458Y (636) ------
CH505w136.B18gp120G458Y                (478)  ------
CH505w136.B18gp140cG458Y               (650)  ------
CH505w136.B18gp160G458Y                (724)  DDLRSLCLFLYHPLRDFILIAARAGELLGRSSLKGLRRGWEALKYLGSLV
                              Consensus (751)
                                              801                                                  850
CH505w136.B18chim.6R.SOSIP.664G458Y    (658)  ------
CH505w136.B18chim.6R.SOSIP.664v4.1G458Y (636) ------
CH505w136.B18gp120G458Y                (478)  ------
CH505w136.B18gp140cG458Y               (650)  ------
CH505w136.B18gp160G458Y                (774)  QYWGLELKRSAISLLDTLAIAVGEGTDRILEFVLGICRAIRNIPTRIRQG
                              Consensus (801)
                                              851
CH505w136.B18chim.6R.SOSIP.664G458Y    (658)  --------
CH505w136.B18chim.6R.SOSIP.664v4.1G458Y (636) --------
CH505w136.B18gp120G458Y                (478)  --------
CH505w136.B18gp140cG458Y               (650)  --------
CH505w136.B18gp160G458Y                (824)  FETALL---
                              Consensus (851)
```

Figure 81 cont.

|  |  | 1 | 50 |
|---|---|---|---|
| CH505week53.16gp120G458Y | (1) | ---- | |
| CH505week53.16gp140cG458Y | (1) | ---- | |
| CH505week53.16gp160G458Y | (1) | ---- | |
| CH505w053.16.chim.6R.SOSIP.664G458Y | (1) | AEN | |
| CH505w053.16.chim.6P.SOSIP.664v4.1G458Y | (1) | AEN | |
| Consensus | (1) | MWVTVYYGVPVWKEAKTTLFCASDAKAYEKEVHNVWATHACVPTDPN | |

|  |  | 51 | 100 |
|---|---|---|---|
| CH505week53.16gp120G458Y | (48) | | |
| CH505week53.16gp140cG458Y | (48) | | |
| CH505week53.16gp160G458Y | (48) | | |
| CH505w053.16.chim.6R.SOSIP.664G458Y | (51) | | |
| CH505w053.16.chim.6P.SOSIP.664v4.1G458Y | (51) | | |
| Consensus | (51) | PQEMVLKNVTENFNMWKNDMVDQMHEDVISLWDQSLKPCVKLTPLCVTLN | |

|  |  | 101 | 150 |
|---|---|---|---|
| CH505week53.16gp120G458Y | (98) | | |
| CH505week53.16gp140cG458Y | (98) | | |
| CH505week53.16gp160G458Y | (98) | | |
| CH505w053.16.chim.6R.SOSIP.664G458Y | (101) | | |
| CH505w053.16.chim.6P.SOSIP.664v4.1G458Y | (101) | | |
| Consensus | (101) | CTNANATASNSSIIEGMNSSIIEGMKNCSFNITTELRDKPERKNALFYKL | |

|  |  | 151 | 200 |
|---|---|---|---|
| CH505week53.16gp120G458Y | (148) | | |
| CH505week53.16gp140cG458Y | (148) | | |
| CH505week53.16gp160G458Y | (148) | | |
| CH505w053.16.chim.6R.SOSIP.664G458Y | (151) | | |
| CH505w053.16.chim.6P.SOSIP.664v4.1G458Y | (151) | | |
| Consensus | (151) | DIVQLDGNSSQYRLINCNTSVITQACPKVSFDPIPIHYCAPAGYAILKCN | |

|  |  | 201 | 250 |
|---|---|---|---|
| CH505week53.16gp120G458Y | (198) | | |
| CH505week53.16gp140cG458Y | (198) | | |
| CH505week53.16gp160G458Y | (198) | | |
| CH505w053.16.chim.6R.SOSIP.664G458Y | (201) | | |
| CH505w053.16.chim.6P.SOSIP.664v4.1G458Y | (201) | | |
| Consensus | (201) | NKTFNGTGPCNNVSTVQCTHGIKPVVSTQLLLNGSLAEGEIIIRSENITD | |

|  |  | 251 | 300 |
|---|---|---|---|
| CH505week53.16gp120G458Y | (248) | | |
| CH505week53.16gp140cG458Y | (248) | | |
| CH505week53.16gp160G458Y | (248) | | |
| CH505w053.16.chim.6R.SOSIP.664G458Y | (251) | | |
| CH505w053.16.chim.6P.SOSIP.664v4.1G458Y | (251) | | |
| Consensus | (251) | NGKTIIVHLNESVKIECTRPSNNTRTSIPIGPGQAFYATGQVIGDIREAH | |

|  |  | 301 | 350 |
|---|---|---|---|
| CH505week53.16gp120G458Y | (298) | | |
| CH505week53.16gp140cG458Y | (298) | | |
| CH505week53.16gp160G458Y | (298) | | |
| CH505w053.16.chim.6R.SOSIP.664G458Y | (301) | | |
| CH505w053.16.chim.6P.SOSIP.664v4.1G458Y | (301) | | |
| Consensus | (301) | CNISESKWNETLQKVSEKLKEYFPRKNITFQPSSGGDLEITTHSFNCGGE | |

|  |  | 351 | 400 |
|---|---|---|---|
| CH505week53.16gp120G458Y | (348) | | |
| CH505week53.16gp140cG458Y | (348) | | |
| CH505week53.16gp160G458Y | (348) | | |
| CH505w053.16.chim.6R.SOSIP.664G458Y | (351) | | |
| CH505w053.16.chim.6P.SOSIP.664v4.1G458Y | (351) | | |
| Consensus | (351) | FFYCNTSSLFNRTYMATSTDMANSTETNSTRIITIRCRIKQIINMWQEVG | |

|  |  | 401 | 450 |
|---|---|---|---|
| CH505week53.16gp120G458Y | (398) | | |
| CH505week53.16gp140cG458Y | (398) | | |
| CH505week53.16gp160G458Y | (398) | | |
| CH505w053.16.chim.6R.SOSIP.664G458Y | (401) | | |
| CH505w053.16.chim.6P.SOSIP.664v4.1G458Y | (401) | | |
| Consensus | (401) | RAMYAPPIAGNITCISNITGLLLTRDGGKNNTETFRPGGGNMKDNWR | |

Figure 81 cont.

```
                                        451                                              500
       CH505week53.16gp120G458Y  (448)   SELYKYKV....KPLGVAP...........E------------------
       CH505week53.16gp140cG458Y  (448)  SELYKYKV....KPLGVAP...........E------------------
       CH505week53.16gp160G458Y  (448)   SELYKYKV....KPLGVAP...........E------------------
   CH505w053.16.chim.6R.SOSIP.664G458Y   (451) SELYKYKV....KPLGVAPT.........RR
   CH505w053.16.chim.6R.SOSIP.664v4.1G458Y (451) SELYKYKV....KPLGVAPT.........RR
                        Consensus  (451)  SELYKYKVVEVKPLGVAPTNARRRVVEREKR AVGIGAVFLGFLGAAGS
                                        501                                              550
       CH505week53.16gp120G458Y  (479)   ------------------------------------------------
       CH505week53.16gp140cG458Y  (496)
       CH505week53.16gp160G458Y  (496)
   CH505w053.16.chim.6R.SOSIP.664G458Y   (501)
   CH505w053.16.chim.6R.SOSIP.664v4.1G458Y (501)
                        Consensus  (501)  TMGAASITLTVQARNLLSGIVQQQSNLLKA EAQQHLLKLTVWGIKQLQA
                                        551                                              600
       CH505week53.16gp120G458Y  (479)   ------------------------------------------------
       CH505week53.16gp140cG458Y  (546)                                T       Y       TYG
       CH505week53.16gp160G458Y  (546)                                T       Y       TYG
   CH505w053.16.chim.6R.SOSIP.664G458Y   (551)                                         NLS
   CH505w053.16.chim.6R.SOSIP.664v4.1G458Y (551)                                        NLS
                        Consensus  (551)  RVLALERYLKDQQLLGIWGCSGKLIC TNV WNSSWSNK   DIWDNMTW
                                        601                                              650
       CH505week53.16gp120G458Y  (479)   ------------------------------------------------
       CH505week53.16gp140cG458Y  (596)           L  E                    RWNSLWNWFNITNW
       CH505week53.16gp160G458Y  (596)           L  E                    RWNSLWNWFNITNW
   CH505w053.16.chim.6R.SOSIP.664G458Y   (601)           L  G                    ------------
   CH505w053.16.chim.6R.SOSIP.664v4.1G458Y (601)           L  G                    ------------
                        Consensus  (601)  LQWDKEISNYT IIY LLEESQNQQEKNEQDLLALD
                                        651                                              700
       CH505week53.16gp120G458Y  (479)   ------------------------------------------------
       CH505week53.16gp140cG458Y  (646)  LWYIK-------------------------------------------
       CH505week53.16gp160G458Y  (646)   LWYIKIFIMIVGGLIGLRIIFAVLSLVNRVRQGYSPLSLQTLIPSPPGPD
   CH505w053.16.chim.6R.SOSIP.664G458Y   (637) ------------------------------------------------
   CH505w053.16.chim.6R.SOSIP.664v4.1G458Y (637) ------------------------------------------------
                        Consensus  (651)
                                        701                                              750
       CH505week53.16gp120G458Y  (479)   ------------------------------------------------
       CH505week53.16gp140cG458Y  (651)  ------------------------------------------------
       CH505week53.16gp160G458Y  (696)   PPGGIEEEGGEQDRNKSTRLVSGFLALAWDDLRSLCLFIYHRLRDFILIA
   CH505w053.16.chim.6R.SOSIP.664G458Y   (637) ------------------------------------------------
   CH505w053.16.chim.6R.SOSIP.664v4.1G458Y (637) ------------------------------------------------
                        Consensus  (701)
                                        751                                              800
       CH505week53.16gp120G458Y  (479)   ------------------------------------------------
       CH505week53.16gp140cG458Y  (651)  ------------------------------------------------
       CH505week53.16gp160G458Y  (746)   ARAGELLGRSSLKGLRRGWEALKYLGSLVQYWGLELKRSAISLLDTLAIA
   CH505w053.16.chim.6R.SOSIP.664G458Y   (637) ------------------------------------------------
   CH505w053.16.chim.6R.SOSIP.664v4.1G458Y (637) ------------------------------------------------
                        Consensus  (751)
                                        801                      836
       CH505week53.16gp120G458Y  (479)   -----------------------------
       CH505week53.16gp140cG458Y  (651)  -----------------------------
       CH505week53.16gp160G458Y  (796)   VGEGTDRILEFVLGICRAIPNIPTRIPQGFETALL-
   CH505w053.16.chim.6R.SOSIP.664G458Y   (637) -----------------------------
   CH505w053.16.chim.6R.SOSIP.664v4.1G458Y (637) -----------------------------
                        Consensus  (801)
```

Figure 81 cont.

```
                                        1                                                  50
CH505M11chim.6R.SOSIP.664G458Y    (1)   AEN...
CH505M11chim.6R.SOSIP.664v4.1G458Y (1)  AEN...
          CH505M11gp120G458Y      (1)   ---...
          CH505M11gp140cG458Y     (1)   ---...
          CH505M11gp160G458Y      (1)   ---...
                       Consensus  (1)   MWVTVYYGVPVWKEAKTTLFCASDAKAYEKEVHNVWATHACVPTDPN
                                        51                                                100
CH505M11chim.6R.SOSIP.664G458Y    (51)
CH505M11chim.6R.SOSIP.664v4.1G458Y (51)
          CH505M11gp120G458Y      (48)
          CH505M11gp140cG458Y     (48)
          CH505M11gp160G458Y      (48)
                       Consensus  (51)  PQEMVLKNVTENFNMWKNDMVDQMHEDVISLWDQSLKPCVKLTPLCVTLN
                                        101                                               150
CH505M11chim.6R.SOSIP.664G458Y    (101)
CH505M11chim.6R.SOSIP.664v4.1G458Y (101)
          CH505M11gp120G458Y      (98)
          CH505M11gp140cG458Y     (98)
          CH505M11gp160G458Y      (98)
                       Consensus  (101) CTNATASNSSIIEGMKNCSFNITTELRDKPERKNALFYKLDIVQLDGNSS
                                        151                                               200
CH505M11chim.6R.SOSIP.664G458Y    (151)
CH505M11chim.6R.SOSIP.664v4.1G458Y (151)
          CH505M11gp120G458Y      (148)
          CH505M11gp140cG458Y     (148)
          CH505M11gp160G458Y      (148)
                       Consensus  (151) QYRLINCNTSVITQACPKVSFDPIPIHYCAPAGYAILKCNNKTFTGTGPC
                                        201                                               250
CH505M11chim.6R.SOSIP.664G458Y    (201)
CH505M11chim.6R.SOSIP.664v4.1G458Y (201)
          CH505M11gp120G458Y      (198)
          CH505M11gp140cG458Y     (198)
          CH505M11gp160G458Y      (198)
                       Consensus  (201) NNVSTVQCTHGIKPVVSTQLLLNGSLAESEIIIRSENITDNGKTIIVHLN
                                        251                                               300
CH505M11chim.6R.SOSIP.664G458Y    (251)
CH505M11chim.6R.SOSIP.664v4.1G458Y (251)
          CH505M11gp120G458Y      (248)
          CH505M11gp140cG458Y     (248)
          CH505M11gp160G458Y      (248)
                       Consensus  (251) ESVKIECTRPNNKTRTSIPIGPGQAFYATGQVIGDIREAYCNINESKWNE
                                        301                                               350
CH505M11chim.6R.SOSIP.664G458Y    (301)
CH505M11chim.6R.SOSIP.664v4.1G458Y (301)
          CH505M11gp120G458Y      (298)
          CH505M11gp140cG458Y     (298)
          CH505M11gp160G458Y      (298)
                       Consensus  (301) TLQRVSKKLKEYFPHKNITFQPSSGGDLEITTHSFNCGGEFFYCNTSSLF
                                        351                                               400
CH505M11chim.6R.SOSIP.664G458Y    (351)
CH505M11chim.6R.SOSIP.664v4.1G458Y (351)
          CH505M11gp120G458Y      (348)
          CH505M11gp140cG458Y     (348)
          CH505M11gp160G458Y      (348)
                       Consensus  (351) NRTYMANSTDMANSTETNSTRTITIHCRIKQIINMWQEVGRAMYAPPIAG
                                        401                                               450
CH505M11chim.6R.SOSIP.664G458Y    (401)
CH505M11chim.6R.SOSIP.664v4.1G458Y (401)
          CH505M11gp120G458Y      (398)
          CH505M11gp140cG458Y     (398)
          CH505M11gp160G458Y      (398)
                       Consensus  (401) NITCISNITGLLLTRDGGKNNTETFRPGGGNMKDNWRSELYKYKVVEVKP
```

Figure 81 cont.

```
                              451                                           500
CH505M11chim.6R.SOSIP.664G458Y  (451) ░░░░░░░░░░░░░░░░░░░░░░░░░░░░░░░░░░░░░░░░░░░░░░░░░
CH505M11chim.6R.SOSIP.664v4.1G458Y (451) ░░░░░░░░░░░░░░░░░░░░░░░░░░░░░░░░░░░░░░░░░░░░░░░░░
              CH505M11gp120G458Y  (448) ░░░░░░░░░░░░░░░-----------------------------------
              CH505M11gp140cG458Y (448) ░░░░░░░░░░░░░░░░░░░░░░░░░░░░░░░░░░░░░░░░░░░░░░░░░
              CH505M11gp160G458Y  (448) ░░░░░░░░░░░░░░░░░░░░░░░░░░░░░░░░░░░░░░░░░░░░░░░░░
                       Consensus  (451) LGVAPTNARRPVVEREKP  AVGIGAVFLGFLGAAGSTMGAASITLTVQA
                              501                                           550
CH505M11chim.6R.SOSIP.664G458Y    (501) ░░░░░░░░░░░░░░░░░░░░░░░░░░░░░░░░░░░░░░░░░░░░░░░░░
CH505M11chim.6R.SOSIP.664v4.1G458Y (501) ░░░░░░░░░░░░░░░░░░░░░░░░░░░░░░░░░░░░░░░░░░░░░░░░░
              CH505M11gp120G458Y  (466) --------------------------------------------------
              CH505M11gp140cG458Y (496) ░░░░░░░░░░░░░░░░░░░░░░░░░░░░░░░░░░░░░░░░░░░░░░░░░
              CH505M11gp160G458Y  (496) ░░░░░░░░░░░░░░░░░░░░░░░░░░░░░░░░░░░░░░░░░░░░░░░░░
                       Consensus  (501) RNLLSGIVQQQSNLLKA EAQQHLLKLTVWGIKQLQARVLALERYLKDQQ
                              551                                           600
CH505M11chim.6R.SOSIP.664G458Y    (551) ░░░░░░░░░░░░░░░░░░░░░░NLS░░░░░░░░░░░░░░░░░░░░░░░░
CH505M11chim.6R.SOSIP.664v4.1G458Y (551) ░░░░░░░░░░░░░░░░░░░░░░NLS░░░░░░░░░░░░░░░░░░░░░░░░
              CH505M11gp120G458Y  (466) --------------------------------------------------
              CH505M11gp140cG458Y (546) ░░░░░░░░░░░░░░░░░░░░TYG░░░░░░░░░░░░░░░░░░░░░░░░░░
              CH505M11gp160G458Y  (546) ░░░░░░░░░░░░░░░░░░░░TYG░░░░░░░░░░░░░░░░░░░░░░░░░░
                       Consensus  (551) LLGIWGCSGKLIC TRV WNSSWSNK  DIWDNMTWLQWDKEISNYT I
                              601                                           650
CH505M11chim.6R.SOSIP.664G458Y    (601) ░░░░░░░░░░░░░░░░░░░░░░░-----------------------------
CH505M11chim.6R.SOSIP.664v4.1G458Y (601) ░░░░░░░░░░░░░░░░░░░░░░░-----------------------------
              CH505M11gp120G458Y  (466) --------------------------------------------------
              CH505M11gp140cG458Y (596) ░░░░░░░░░░░░░░░░░░░░░░░RWNSLWNWFNITNWLWYIK--------
              CH505M11gp160G458Y  (596) ░░░░░░░░░░░░░░░░░░░░░░░RWNSLWNWFNITNWLWYIKIFIMIVGG
                       Consensus  (601) IY LLEESQNQQEKNEQDLLALD
                              651                                           700
CH505M11chim.6R.SOSIP.664G458Y    (624) --------------------------------------------------
CH505M11chim.6R.SOSIP.664v4.1G458Y (624) --------------------------------------------------
              CH505M11gp120G458Y  (466) --------------------------------------------------
              CH505M11gp140cG458Y (638) --------------------------------------------------
              CH505M11gp160G458Y  (646) LIGLRIIFAVLSLVNRVRQGYSFLSLQTLIPSPPGPDRPGGIEEEGGEQD
                       Consensus  (651)
                              701                                           750
CH505M11chim.6R.SOSIP.664G458Y    (624) --------------------------------------------------
CH505M11chim.6R.SOSIP.664v4.1G458Y (624) --------------------------------------------------
              CH505M11gp120G458Y  (466) --------------------------------------------------
              CH505M11gp140cG458Y (638) --------------------------------------------------
              CH505M11gp160G458Y  (696) RNRSTPLVSGFLALVWDDLPSLCLFIYHRLRDFILIAAPAGELLGPSSLK
                       Consensus  (701)
                              751                                           800
CH505M11chim.6R.SOSIP.664G458Y    (624) --------------------------------------------------
CH505M11chim.6R.SOSIP.664v4.1G458Y (624) --------------------------------------------------
              CH505M11gp120G458Y  (466) --------------------------------------------------
              CH505M11gp140cG458Y (638) --------------------------------------------------
              CH505M11gp160G458Y  (746) GLRPGWEALKYLGSLVQYWGLELKPSAISLLDTLAIAVGEGTDRILEFVL
                       Consensus  (751)
                              801            824
CH505M11chim.6R.SOSIP.664G458Y    (624) ------------------------
CH505M11chim.6R.SOSIP.664v4.1G458Y (624) ------------------------
              CH505M11gp120G458Y  (466) ------------------------
              CH505M11gp140cG458Y (638) ------------------------
              CH505M11gp160G458Y  (796) GICRAIRNIPTRIRQGFETALL--
                       Consensus  (801)
```

Figure 81 cont.

```
                                              1                                                  50
CH505M5chim.6P.SOSIP.664G458Y    (1)  AEN░░░░░░░░░░░░░░░░░░░░░░░░░░░░░░░░░░░░░░░░░░░░░░░░
CH505M5chim.6R.SOSIP.664v4.1G458Y (1) AEN░░░░░░░░░░░░░░░░░░░░░░░░░░░░░░░░░░░░░░░░░░░░░░░░
            CH505M5gp120G458Y    (1)  ---░░░░░░░░░░░░░░░░░░░░░░░░░░░░░░░░░░░░░░░░░░░░░░░░
            CH505M5gp140cG458Y   (1)  ---░░░░░░░░░░░░░░░░░░░░░░░░░░░░░░░░░░░░░░░░░░░░░░░░
            CH505M5gp160G458Y    (1)  ---░░░░░░░░░░░░░░░░░░░░░░░░░░░░░░░░░░░░░░░░░░░░░░░░
                       Consensus (1)  MRVTVYYGVPVWKEATTTLFCASDAKAYEKEVHNVWATHACVPTDPN
                                              51                                                 100
CH505M5chim.6P.SOSIP.664G458Y    (51) ░░░░░░░░░░░░░░░░░░░░░░░░░░░░░░░░░░░░░░░░░░░░░░░░░
CH505M5chim.6R.SOSIP.664v4.1G458Y (51)░░░░░░░░░░░░░░░░░░░░░░░░░░░░░░░░░░░░░░░░░░░░░░░░░
            CH505M5gp120G458Y    (48) ░░░░░░░░░░░░░░░░░░░░░░░░░░░░░░░░░░░░░░░░░░░░░░░░░
            CH505M5gp140cG458Y   (48) ░░░░░░░░░░░░░░░░░░░░░░░░░░░░░░░░░░░░░░░░░░░░░░░░░
            CH505M5gp160G458Y    (48) ░░░░░░░░░░░░░░░░░░░░░░░░░░░░░░░░░░░░░░░░░░░░░░░░░
                       Consensus (51) PQEMVLKNVTENFNMWKNDMVDQMHEDVISLWDQSLKPCVKLTPLCVTLN
                                              101                                                150
CH505M5chim.6P.SOSIP.664G458Y    (101)░░░░░░░░░░░░░░░░░░░░░░░░░░░░░░░░░░░░░░░░░░░░░░░░░
CH505M5chim.6R.SOSIP.664v4.1G458Y (101)░░░░░░░░░░░░░░░░░░░░░░░░░░░░░░░░░░░░░░░░░░░░░░░░
            CH505M5gp120G458Y    (98) ░░░░░░░░░░░░░░░░░░░░░░░░░░░░░░░░░░░░░░░░░░░░░░░░░
            CH505M5gp140cG458Y   (98) ░░░░░░░░░░░░░░░░░░░░░░░░░░░░░░░░░░░░░░░░░░░░░░░░░
            CH505M5gp160G458Y    (98) ░░░░░░░░░░░░░░░░░░░░░░░░░░░░░░░░░░░░░░░░░░░░░░░░░
                       Consensus (101)CTNATASNSSIIEGMKNCSFNITTELRDKREKKNALFYKLDIVQLDGNSS
                                              151                                                200
CH505M5chim.6P.SOSIP.664G458Y    (151)░░░░░░░░░░░░░░░░░░░░░░░░░░░░░░░░░░░░░░░░░░░░░░░░░
CH505M5chim.6R.SOSIP.664v4.1G458Y (151)░░░░░░░░░░░░░░░░░░░░░░░░░░░░░░░░░░░░░░░░░░░░░░░░
            CH505M5gp120G458Y    (148)░░░░░░░░░░░░░░░░░░░░░░░░░░░░░░░░░░░░░░░░░░░░░░░░░
            CH505M5gp140cG458Y   (148)░░░░░░░░░░░░░░░░░░░░░░░░░░░░░░░░░░░░░░░░░░░░░░░░░
            CH505M5gp160G458Y    (148)░░░░░░░░░░░░░░░░░░░░░░░░░░░░░░░░░░░░░░░░░░░░░░░░░
                       Consensus (151)QYRLINCNTSVITQACPKVSFDPIPIHYCAPAGYAILKCNNKTFTGTGPC
                                              201                                                250
CH505M5chim.6P.SOSIP.664G458Y    (201)░░░░░░░░░░░░░░░░░░░░░░░░░░░░░░░░░░░░░░░░░░░░░░░░░
CH505M5chim.6R.SOSIP.664v4.1G458Y (201)░░░░░░░░░░░░░░░░░░░░░░░░░░░░░░░░░░░░░░░░░░░░░░░░
            CH505M5gp120G458Y    (198)░░░░░░░░░░░░░░░░░░░░░░░░░░░░░░░░░░░░░░░░░░░░░░░░░
            CH505M5gp140cG458Y   (198)░░░░░░░░░░░░░░░░░░░░░░░░░░░░░░░░░░░░░░░░░░░░░░░░░
            CH505M5gp160G458Y    (198)░░░░░░░░░░░░░░░░░░░░░░░░░░░░░░░░░░░░░░░░░░░░░░░░░
                       Consensus (201)NNVSTVQCTHGIKPVVSTQLLLNGSLAEGEIIIPSENITKNVKTIIVHLN
                                              251                                                300
CH505M5chim.6P.SOSIP.664G458Y    (251)░░░░░░░░░░░░░░░░░░░░░░░░░░░░░░░░░░░░░░░░░░░░░░░░░
CH505M5chim.6R.SOSIP.664v4.1G458Y (251)░░░░░░░░░░░░░░░░░░░░░░░░░░░░░░░░░░░░░░░░░░░░░░░░
            CH505M5gp120G458Y    (248)░░░░░░░░░░░░░░░░░░░░░░░░░░░░░░░░░░░░░░░░░░░░░░░░░
            CH505M5gp140cG458Y   (248)░░░░░░░░░░░░░░░░░░░░░░░░░░░░░░░░░░░░░░░░░░░░░░░░░
            CH505M5gp160G458Y    (248)░░░░░░░░░░░░░░░░░░░░░░░░░░░░░░░░░░░░░░░░░░░░░░░░░
                       Consensus (251)ESVKIECTRPNNKTRTSIRIGPGQAFYATGQVIGDIREAYCNINESKWNE
                                              301                                                350
CH505M5chim.6P.SOSIP.664G458Y    (301)░░░░░░░░░░░░░░░░░░░░░░░░░░░░░░░░░░░░░░░░░░░░░░░░░
CH505M5chim.6R.SOSIP.664v4.1G458Y (301)░░░░░░░░░░░░░░░░░░░░░░░░░░░░░░░░░░░░░░░░░░░░░░░░
            CH505M5gp120G458Y    (298)░░░░░░░░░░░░░░░░░░░░░░░░░░░░░░░░░░░░░░░░░░░░░░░░░
            CH505M5gp140cG458Y   (298)░░░░░░░░░░░░░░░░░░░░░░░░░░░░░░░░░░░░░░░░░░░░░░░░░
            CH505M5gp160G458Y    (298)░░░░░░░░░░░░░░░░░░░░░░░░░░░░░░░░░░░░░░░░░░░░░░░░░
                       Consensus (301)TLQPVSKKLKEYFPHKNITFQPSSGGDLEITTHSFNCGGEFFYCNTSSLF
                                              351                                                400
CH505M5chim.6P.SOSIP.664G458Y    (351)░░░░░░░░░░░░░░░░░░░░░░░░░░░░░░░░░░░░░░░░░░░░░░░░░
CH505M5chim.6R.SOSIP.664v4.1G458Y (351)░░░░░░░░░░░░░░░░░░░░░░░░░░░░░░░░░░░░░░░░░░░░░░░░
            CH505M5gp120G458Y    (348)░░░░░░░░░░░░░░░░░░░░░░░░░░░░░░░░░░░░░░░░░░░░░░░░░
            CH505M5gp140cG458Y   (348)░░░░░░░░░░░░░░░░░░░░░░░░░░░░░░░░░░░░░░░░░░░░░░░░░
            CH505M5gp160G458Y    (348)░░░░░░░░░░░░░░░░░░░░░░░░░░░░░░░░░░░░░░░░░░░░░░░░░
                       Consensus (351)NRTYMANSTDMANSTETNSTPTITIHCRIKQIINMWQEVGRAMYAPPIAG
                                              401                                                450
CH505M5chim.6P.SOSIP.664G458Y    (401)░░░░░░░░░░░░░░░░░░░░░░░░░░░░░░░░░░░░░░░░░░░░░░░░░
CH505M5chim.6R.SOSIP.664v4.1G458Y (401)░░░░░░░░░░░░░░░░░░░░░░░░░░░░░░░░░░░░░░░░░░░░░░░░
            CH505M5gp120G458Y    (398)░░░░░░░░░░░░░░░░░░░░░░░░░░░░░░░░░░░░░░░░░░░░░░░░░
            CH505M5gp140cG458Y   (398)░░░░░░░░░░░░░░░░░░░░░░░░░░░░░░░░░░░░░░░░░░░░░░░░░
            CH505M5gp160G458Y    (398)░░░░░░░░░░░░░░░░░░░░░░░░░░░░░░░░░░░░░░░░░░░░░░░░░
                       Consensus (401)NITCISNITGLLLTRDGGKNNTETFRPGGGNMKDNWRSELYKYKVVEVKP
```

Figure 81 cont.

```
                                              451                                          500
CH505M5chim.6R.SOSIP.664G458Y   (451) [_____]
CH505M5chim.6R.SOSIP.664v4.1G458Y (451) [_____]
         CH505M5gp120G458Y       (448) [_____]------------------
         CH505M5gp140cG458Y      (448) [_____]--------
         CH505M5gp160G458Y       (448) [_____]
              Consensus          (451) LGVAPTNARPRVVEREKR  AVGIGAVFLGFLGAAGSTMGAASITLTVQA
                                              501                                          550
CH505M5chim.6R.SOSIP.664G458Y   (501) [_____]
CH505M5chim.6R.SOSIP.664v4.1G458Y (501) [_____]
         CH505M5gp120G458Y       (466) --------------------------------------------
         CH505M5gp140cG458Y      (496) [_____]
         CH505M5gp160G458Y       (498) [_____]
              Consensus          (501) RNLLSGIVQQQSNLLKA EAQQHLLKLTVWGIKQLQAPVLALERYLKDQQ
                                              551                                          600
CH505M5chim.6R.SOSIP.664G458Y   (551) [_____C__F___NLS_____Q_____]
CH505M5chim.6R.SOSIP.664v4.1G458Y (551) [_____C__F___NLS_____Q_____]
         CH505M5gp120G458Y       (466) --------------------------------------------
         CH505M5gp140cG458Y      (546) [_____T_____TYG_____E_____]
         CH505M5gp160G458Y       (548) [_____T_____TYG_____E_____]
              Consensus          (551) LLGIWGCSGKLIC TNV WNSSWSNK  DIWDNMTWLQWDKEISNYT I
                                              601                                          650
CH505M5chim.6R.SOSIP.664G458Y   (601) [_____C_____]---------------------
CH505M5chim.6R.SOSIP.664v4.1G458Y (601) [_____C_____]---------------------
         CH505M5gp120G458Y       (466) --------------------------------------------
         CH505M5gp140cG458Y      (596) [_____]RWNSLWNWFNITNWLWYIK--------
         CH505M5gp160G458Y       (598) [_____]RWNSLWNWFNITNWLWYIKIFIMIVGG
              Consensus          (601) IY LLEESQRQQEKNEQDLLALD
                                              651                                          700
CH505M5chim.6R.SOSIP.664G458Y   (624) --------------------------------------------
CH505M5chim.6R.SOSIP.664v4.1G458Y (624) --------------------------------------------
         CH505M5gp120G458Y       (466) --------------------------------------------
         CH505M5gp140cG458Y      (638) --------------------------------------------
         CH505M5gp160G458Y       (646) LIGLRIIFAVLSLVNRVRQGYSPLSLQTLIPSPRGPDRPGGIEEEGGEQD
              Consensus          (651)
                                              701                                          750
CH505M5chim.6R.SOSIP.664G458Y   (624) --------------------------------------------
CH505M5chim.6R.SOSIP.664v4.1G458Y (624) --------------------------------------------
         CH505M5gp120G458Y       (466) --------------------------------------------
         CH505M5gp140cG458Y      (638) --------------------------------------------
         CH505M5gp160G458Y       (696) RNRSTRLVSGFLALVWDDLRSLCLFIYHRLRDFILIAARAGELLGRSSLK
              Consensus          (701)
                                              751                                          800
CH505M5chim.6R.SOSIP.664G458Y   (624) --------------------------------------------
CH505M5chim.6R.SOSIP.664v4.1G458Y (624) --------------------------------------------
         CH505M5gp120G458Y       (466) --------------------------------------------
         CH505M5gp140cG458Y      (638) --------------------------------------------
         CH505M5gp160G458Y       (746) GLPRGWEALKYLGSLVQYWGLELKRSAISLLDTLAIAVGEGTDRILEFVL
              Consensus          (751)
                                              801           824
CH505M5chim.6R.SOSIP.664G458Y   (624) ------------------------
CH505M5chim.6R.SOSIP.664v4.1G458Y (624) ------------------------
         CH505M5gp120G458Y       (466) ------------------------
         CH505M5gp140cG458Y      (638) ------------------------
         CH505M5gp160G458Y       (796) GICRAIRNIPTRIRQGFETALL--
              Consensus          (801)
```

Figure 81 cont.

```
                                              1                                                  50
        CH505w020.14gp120G458Y      (1)  ---
        CH505w020.14gp140cG458Y     (1)  ---
        CH505w020.14gp160G458Y      (1)  ---
 CH505w20.14chim.6R.SOSIP.664G458Y  (1)  AEN
CH505w20.14chim.6R.SOSIP.664v4.1G458Y (1) AEN
                         Consensus  (1)  MWVTVYYGVPVWKEAKTTLFCASDAKAYEKEVHNVWATHACVPTDPN
                                             51                                                 100
        CH505w020.14gp120G458Y     (48)
        CH505w020.14gp140cG458Y    (48)
        CH505w020.14gp160G458Y     (48)
 CH505w20.14chim.6R.SOSIP.664G458Y (51)
CH505w20.14chim.6R.SOSIP.664v4.1G458Y (51)
                         Consensus (51) PQEMVLKNVTENFNMWKNDMVDQMHEDVISLWDQSLKPCVKLTPLCVTLN
                                            101                                                 150
        CH505w020.14gp120G458Y     (98)
        CH505w020.14gp140cG458Y    (98)
        CH505w020.14gp160G458Y     (98)
 CH505w20.14chim.6R.SOSIP.664G458Y (101)
CH505w20.14chim.6R.SOSIP.664v4.1G458Y (101)
                         Consensus (101) CTNATASNNSIIEGMKNCSFNITTELRDKREKKNALFYKLDIVQLDGNSS
                                            151                                                 200
        CH505w020.14gp120G458Y    (148)
        CH505w020.14gp140cG458Y   (148)
        CH505w020.14gp160G458Y    (148)
 CH505w20.14chim.6R.SOSIP.664G458Y (151)
CH505w20.14chim.6R.SOSIP.664v4.1G458Y (151)
                         Consensus (151) QYRLINCNTSVITQACPKVSFDPIPIHYCAPAGYAILKCNNKTFTGTGPC
                                            201                                                 250
        CH505w020.14gp120G458Y    (198)
        CH505w020.14gp140cG458Y   (198)
        CH505w020.14gp160G458Y    (198)
 CH505w20.14chim.6R.SOSIP.664G458Y (201)
CH505w20.14chim.6R.SOSIP.664v4.1G458Y (201)
                         Consensus (201) NNVSTVQCTHGIKPVVSTQLLLNGSLAEGEIIIRSENITNNAKTIIVHLN
                                            251                                                 300
        CH505w020.14gp120G458Y    (248)
        CH505w020.14gp140cG458Y   (248)
        CH505w020.14gp160G458Y    (248)
 CH505w20.14chim.6R.SOSIP.664G458Y (251)
CH505w20.14chim.6R.SOSIP.664v4.1G458Y (251)
                         Consensus (251) ESVKIECTRPNNKTRTSIRIGPGQAFYATGQVIGDIPKAYCNISESKWNE
                                            301                                                 350
        CH505w020.14gp120G458Y    (298)
        CH505w020.14gp140cG458Y   (298)
        CH505w020.14gp160G458Y    (298)
 CH505w20.14chim.6R.SOSIP.664G458Y (301)
CH505w20.14chim.6R.SOSIP.664v4.1G458Y (301)
                         Consensus (301) TLQRVSKKLKEYFPHKNITFQPSSGGDLEITTHSFNCGGEFFYCNTSSLF
                                            351                                                 400
        CH505w020.14gp120G458Y    (348)
        CH505w020.14gp140cG458Y   (348)
        CH505w020.14gp160G458Y    (348)
 CH505w20.14chim.6R.SOSIP.664G458Y (351)
CH505w20.14chim.6R.SOSIP.664v4.1G458Y (351)
                         Consensus (351) NRTYMANSTDMANSTETNSTRTITLHCRIKQIINMWQEVGRAMYAPPIAG
                                            401                                                 450
        CH505w020.14gp120G458Y    (398)
        CH505w020.14gp140cG458Y   (398)
        CH505w020.14gp160G458Y    (398)
 CH505w20.14chim.6R.SOSIP.664G458Y (401)
CH505w20.14chim.6R.SOSIP.664v4.1G458Y (401)
                         Consensus (401) NITCISNITGLLLTPDYGKNNTETFRPGGGNMKDNWRSELYKYKVVEVKP
```

Figure 81 cont.

```
                                        451                                           500
      CH505w020.14gp120G458Y    (448)  ...............-----------------------------------
      CH505w020.14gp140cG458Y   (448)  ...............F---------------------------------
      CH505w020.14gp160G458Y    (448)  LGVAPTEC..VGEK.PR...............................
  CH505w20.14chim.6R.SOSIP.664G458Y    (451)  ......RC.....KP.RR...............................
CH505w20.14chim.6R.SOSIP.664v4.1G458Y  (451)  ......RC.....KP.RR...............................
                      Consensus (451)  LGVAPTNARRRVVEPEKR  AVGIGAVFLGFLGAAGSTMGAASITLTVQA
                                        501                                           550
      CH505w020.14gp120G458Y    (466)  --------------------------------------------------
      CH505w020.14gp140cG458Y   (496)  .........I........................................
      CH505w020.14gp160G458Y    (496)  .........I........................................
  CH505w20.14chim.6R.SOSIP.664G458Y    (501)  .........P........................................
CH505w20.14chim.6R.SOSIP.664v4.1G458Y  (501)  .........P........................................
                      Consensus (501)  RNLLSGIVQQQSNLLKA EAQQHLLKLTVWGIKQLQARVLALERYLKDQQ
                                        551                                           600
      CH505w020.14gp120G458Y    (466)  --------------------------------------------------
      CH505w020.14gp140cG458Y   (546)  ......T..Y......TYG...............................
      CH505w020.14gp160G458Y    (546)  ......T..Y......TYG...............................
  CH505w20.14chim.6R.SOSIP.664G458Y    (551)  ......C..P......NLS...............................
CH505w20.14chim.6R.SOSIP.664v4.1G458Y  (551)  ......C..P......NLS...............................
                      Consensus (551)  LLGIWGCSGKLIC TNV WNSSWSNK  DIWDNMTWLQWDKEISNYT I
                                        601                                           650
      CH505w020.14gp120G458Y    (466)  --------------------------------------------------
      CH505w020.14gp140cG458Y   (596)  E.......................RWNSLWNWFNITNWLWYIK-------
      CH505w020.14gp160G458Y    (596)  E.......................RWNSLWNWFNITNWLWYIKIFIMIVGG
  CH505w20.14chim.6R.SOSIP.664G458Y    (601)  KG------------------------------------------------
CH505w20.14chim.6R.SOSIP.664v4.1G458Y  (601)  KG------------------------------------------------
                      Consensus (601)  IY LLEESQNQQEKNEQDLLALD
                                        651                                           700
      CH505w020.14gp120G458Y    (466)  --------------------------------------------------
      CH505w020.14gp140cG458Y   (638)  --------------------------------------------------
      CH505w020.14gp160G458Y    (646)  LIGLRIIFAVLSLVNRVRQGYSPLSLQTLIPSPRGPDRPGGIEEEGGEQD
  CH505w20.14chim.6R.SOSIP.664G458Y    (624)  --------------------------------------------------
CH505w20.14chim.6R.SOSIP.664v4.1G458Y  (624)  --------------------------------------------------
                      Consensus (651)
                                        701                                           750
      CH505w020.14gp120G458Y    (466)  --------------------------------------------------
      CH505w020.14gp140cG458Y   (638)  --------------------------------------------------
      CH505w020.14gp160G458Y    (696)  RNPSTRLVSGFLALVWDDLRSLCLFIYHRLRDFILIAARAGELLGRSSLK
  CH505w20.14chim.6R.SOSIP.664G458Y    (624)  --------------------------------------------------
CH505w20.14chim.6R.SOSIP.664v4.1G458Y  (624)  --------------------------------------------------
                      Consensus (701)
                                        751                                           800
      CH505w020.14gp120G458Y    (466)  --------------------------------------------------
      CH505w020.14gp140cG458Y   (638)  --------------------------------------------------
      CH505w020.14gp160G458Y    (746)  GLPRGWEALKYLGSLVQYWGLELKRSAISLLDTLAIAVGESTDRILEFVL
  CH505w20.14chim.6R.SOSIP.664G458Y    (624)  --------------------------------------------------
CH505w20.14chim.6R.SOSIP.664v4.1G458Y  (624)  --------------------------------------------------
                      Consensus (751)
                                        801            824
      CH505w020.14gp120G458Y    (466)  ------------------------
      CH505w020.14gp140cG458Y   (638)  ------------------------
      CH505w020.14gp160G458Y    (796)  GICRAIRNIPTRIRQGFETALL--
  CH505w20.14chim.6R.SOSIP.664G458Y    (624)  ------------------------
CH505w20.14chim.6R.SOSIP.664v4.1G458Y  (624)  ------------------------
                      Consensus (801)
```

Figure 81 cont.

|                                    |       | 1                                                  50 |
|---|---|---|
| CH505w30.20gp120G458Y              | (1)   | ---                                                   |
| CH505w30.20gp140cG458Y             | (1)   | ---                                                   |
| CH505w30.20gp160G458Y              | (1)   | ---                                                   |
| CH505w30.20chim.6R.SOSIP.664G458Y  | (1)   | AEN                                                   |
| CH505w30.20chim.6R.SOSIP.664v4.1G458Y | (1) | AEN                                                   |
| Consensus                          | (1)   | MWVTVYYGVPVWKEAKTTLFCASDAKAYEKEVHNVWATHACVPTDPN       |

|                                    |       | 51                                                 100 |
|---|---|---|
| CH505w30.20gp120G458Y              | (48)  |                                                        |
| CH505w30.20gp140cG458Y             | (48)  |                                                        |
| CH505w30.20gp160G458Y              | (48)  |                                                        |
| CH505w30.20chim.6R.SOSIP.664G458Y  | (51)  |                                                        |
| CH505w30.20chim.6R.SOSIP.664v4.1G458Y | (51) |                                                       |
| Consensus                          | (51)  | PQEMVLKNVTENFNMWKNDMVDQMHEDVISLWDQSLKPCVKLTPLCVTLN     |

|                                    |       | 101                                                150 |
|---|---|---|
| CH505w30.20gp120G458Y              | (98)  |                                                        |
| CH505w30.20gp140cG458Y             | (98)  |                                                        |
| CH505w30.20gp160G458Y              | (98)  |                                                        |
| CH505w30.20chim.6R.SOSIP.664G458Y  | (101) |                                                        |
| CH505w30.20chim.6R.SOSIP.664v4.1G458Y | (101) |                                                     |
| Consensus                          | (101) | CTNATTNATASNSSIIEGMKNCSFNITTELRDKPEKKNALFYKLDIVQLD     |

|                                    |       | 151                                                200 |
|---|---|---|
| CH505w30.20gp120G458Y              | (148) |                                                        |
| CH505w30.20gp140cG458Y             | (148) |                                                        |
| CH505w30.20gp160G458Y              | (148) |                                                        |
| CH505w30.20chim.6R.SOSIP.664G458Y  | (151) |                                                        |
| CH505w30.20chim.6R.SOSIP.664v4.1G458Y | (151) |                                                     |
| Consensus                          | (151) | GNSSQYRLINCNTSVITQACPKVSFDPIPIHYCAPAGYAILKCNNKTFTG     |

|                                    |       | 201                                                250 |
|---|---|---|
| CH505w30.20gp120G458Y              | (198) |                                                        |
| CH505w30.20gp140cG458Y             | (198) |                                                        |
| CH505w30.20gp160G458Y              | (198) |                                                        |
| CH505w30.20chim.6R.SOSIP.664G458Y  | (201) |                                                        |
| CH505w30.20chim.6R.SOSIP.664v4.1G458Y | (201) |                                                     |
| Consensus                          | (201) | TGPCNNVSTVQCTHGIKPVVSTQLLLNGSLAEGEIIIRSENITNNAKTII     |

|                                    |       | 251                                                300 |
|---|---|---|
| CH505w30.20gp120G458Y              | (248) |                                                        |
| CH505w30.20gp140cG458Y             | (248) |                                                        |
| CH505w30.20gp160G458Y              | (248) |                                                        |
| CH505w30.20chim.6R.SOSIP.664G458Y  | (251) |                                                        |
| CH505w30.20chim.6R.SOSIP.664v4.1G458Y | (251) |                                                     |
| Consensus                          | (251) | VHLNESVKIECTRPNNKTRTSIPIGPGQAFYATGQVIGDIREAYCNISES     |

|                                    |       | 301                                                350 |
|---|---|---|
| CH505w30.20gp120G458Y              | (298) |                                                        |
| CH505w30.20gp140cG458Y             | (298) |                                                        |
| CH505w30.20gp160G458Y              | (298) |                                                        |
| CH505w30.20chim.6R.SOSIP.664G458Y  | (301) |                                                        |
| CH505w30.20chim.6R.SOSIP.664v4.1G458Y | (301) |                                                     |
| Consensus                          | (301) | KWNETLQRVSKKLKEYFPHKNITFQPSSGGDLEITTHSFNCGGEFFYCNT     |

|                                    |       | 351                                                400 |
|---|---|---|
| CH505w30.20gp120G458Y              | (348) |                                                        |
| CH505w30.20gp140cG458Y             | (348) |                                                        |
| CH505w30.20gp160G458Y              | (348) |                                                        |
| CH505w30.20chim.6R.SOSIP.664G458Y  | (351) |                                                        |
| CH505w30.20chim.6R.SOSIP.664v4.1G458Y | (351) |                                                     |
| Consensus                          | (351) | SSLFNRTYMANSTDMANSTETNSTKIITIHCRIKQIINMWQEVGPAMYAP     |

|                                    |       | 401                                                450 |
|---|---|---|
| CH505w30.20gp120G458Y              | (398) |                                                        |
| CH505w30.20gp140cG458Y             | (398) |                                                        |
| CH505w30.20gp160G458Y              | (398) |                                                        |
| CH505w30.20chim.6R.SOSIP.664G458Y  | (401) |                                                        |
| CH505w30.20chim.6R.SOSIP.664v4.1G458Y | (401) |                                                     |
| Consensus                          | (401) | PIAGNITCISNITGLLLTRDGGKNTRDGGKNNTETFRPGGGNMKDNWRSE     |

Figure 81 cont.

```
                                                451                                    500
        CH505w30.20gp120G458Y  (448) ...........................-----------------
        CH505w30.20gp140cG458Y (448) ...........................E-----------------
        CH505w30.20gp160G458Y  (448) ...........................E-----------------
    CH505w30.20chim.6R.SOSIP.664G458Y    (451) ...........................RP
    CH505w30.20chim.6R.SOSIP.664v4.1G458Y (451) ...........................PR
                              Consensus (451) LYKYKVVEVKPLGVAPTNARRPVVEREKR  AVGIGAVFLGFLGAAGSTM
                                                501                                    550
        CH505w30.20gp120G458Y  (477) ---------------------------------------------
        CH505w30.20gp140cG458Y (496) ...........................I.................
        CH505w30.20gp160G458Y  (496) ...........................I.................
    CH505w30.20chim.6R.SOSIP.664G458Y    (501) ...........................P.........
    CH505w30.20chim.6R.SOSIP.664v4.1G458Y (501) ...........................P.........
                              Consensus (501) GAASITLTVQARRLLSGIVQQQSNLLRA  EAQQHLLKLTVWGIKQLQARV
                                                551                                    600
        CH505w30.20gp120G458Y  (477) ---------------------------------------------
        CH505w30.20gp140cG458Y (546) ..............T...Y.........TYG
        CH505w30.20gp160G458Y  (546) ..............T...Y.........TYG
    CH505w30.20chim.6R.SOSIP.664G458Y    (551) ..................P.........NLS
    CH505w30.20chim.6R.SOSIP.664v4.1G458Y (551) ..................P.........NLS
                              Consensus (551) LALERYLRDQQLLGIWGCSGKLIC TNV WNSSWSNK  DIWDNMTWLQ
                                                601                                    650
        CH505w30.20gp120G458Y  (477) ---------------------------------------------
        CH505w30.20gp140cG458Y (596) ........E..............RWNSLWNWFNITNWLW
        CH505w30.20gp160G458Y  (596) ........E..............RWNSLWNWFNITNWLW
    CH505w30.20chim.6R.SOSIP.664G458Y    (601) ........Q...........----------
    CH505w30.20chim.6R.SOSIP.664v4.1G458Y (601) ........Q...........----------
                              Consensus (601) WDKEISNYT IIY LLEESQNQQEKNEQDLLALD
                                                651                                    700
        CH505w30.20gp120G458Y  (477) ---------------------------------------------
        CH505w30.20gp140cG458Y (646) YIK------------------------------------------
        CH505w30.20gp160G458Y  (646) YIKIFIMIVGGLIGLRIIFAVLSLVNRVRQGYSPLSLQTLIPSPRGPDRP
    CH505w30.20chim.6R.SOSIP.664G458Y    (635) ---------------------------------------------
    CH505w30.20chim.6R.SOSIP.664v4.1G458Y (635) ---------------------------------------------
                              Consensus (651)
                                                701                                    750
        CH505w30.20gp120G458Y  (477) ---------------------------------------------
        CH505w30.20gp140cG458Y (649) ---------------------------------------------
        CH505w30.20gp160G458Y  (696) GGIEEEGGEQDRNRSTRLVSGFLALAWDDLRSLCLFIYHRLRDFILIAAR
    CH505w30.20chim.6R.SOSIP.664G458Y    (635) ---------------------------------------------
    CH505w30.20chim.6R.SOSIP.664v4.1G458Y (635) ---------------------------------------------
                              Consensus (701)
                                                751                                    800
        CH505w30.20gp120G458Y  (477) ---------------------------------------------
        CH505w30.20gp140cG458Y (649) ---------------------------------------------
        CH505w30.20gp160G458Y  (746) AGELLGRSSLKGLRPGWEALKYLGSLVQYWGLELKPSAISLLDTLAIAVG
    CH505w30.20chim.6R.SOSIP.664G458Y    (635) ---------------------------------------------
    CH505w30.20chim.6R.SOSIP.664v4.1G458Y (635) ---------------------------------------------
                              Consensus (751)
                                                801                         835
        CH505w30.20gp120G458Y  (477) ---------------------------------
        CH505w30.20gp140cG458Y (649) ---------------------------------
        CH505w30.20gp160G458Y  (796) EGTDRILEFVLGICPAIRNIPTRIRQGFETALL--
    CH505w30.20chim.6R.SOSIP.664G458Y    (635) ---------------------------------
    CH505w30.20chim.6R.SOSIP.664v4.1G458Y (635) ---------------------------------
                              Consensus (801)
```

Figure 81 cont.

```
                                      1                                                50
CH505TFchimSOSIP.664.v4.1G458Y    (1)  AEN......................................................
CH505TFchimSOSIP.664G458Y         (1)  AEN......................................................
CH505TFgp120G458Y                 (1)  ---......................................................
CH505TFgp140cG458Y                (1)  ---......................................................
CH505TFgp160G458Y                 (1)  ---......................................................
                    Consensus     (1)     MWVTVYYGVPVWKEAKTTLFCASDAKAYEKEVHNVWATHACVPTDPN
                                      51                                               100
CH505TFchimSOSIP.664.v4.1G458Y   (51)
CH505TFchimSOSIP.664G458Y        (51)
CH505TFgp120G458Y                (48)
CH505TFgp140cG458Y               (48)
CH505TFgp160G458Y                (48)
                    Consensus    (51)  PQEMVLKNVTENFNMWKNDMVDQMHEDVISLWDQSLKPCVKLTPLCVTLN
                                      101                                              150
CH505TFchimSOSIP.664.v4.1G458Y  (101)
CH505TFchimSOSIP.664G458Y       (101)
CH505TFgp120G458Y                (98)
CH505TFgp140cG458Y               (98)
CH505TFgp160G458Y                (98)
                    Consensus   (101)  CTNATASNSSIIEGMKNCSFNITTELRDKREKKNALFYKLDIVQLDGNSS
                                      151                                              200
CH505TFchimSOSIP.664.v4.1G458Y  (151)
CH505TFchimSOSIP.664G458Y       (151)
CH505TFgp120G458Y               (148)
CH505TFgp140cG458Y              (148)
CH505TFgp160G458Y               (148)
                    Consensus   (151)  QYRLINCNTSVITQACPKVSFDPIPIHYCAPAGYAILKCNNKTFTGTGPC
                                      201                                              250
CH505TFchimSOSIP.664.v4.1G458Y  (201)
CH505TFchimSOSIP.664G458Y       (201)
CH505TFgp120G458Y               (198)
CH505TFgp140cG458Y              (198)
CH505TFgp160G458Y               (198)
                    Consensus   (201)  NNVSTVQCTHGIKPVVSTQLLLNGSLAEGEIIIRSENITNNVKTIIVHLN
                                      251                                              300
CH505TFchimSOSIP.664.v4.1G458Y  (251)
CH505TFchimSOSIP.664G458Y       (251)
CH505TFgp120G458Y               (248)
CH505TFgp140cG458Y              (248)
CH505TFgp160G458Y               (248)
                    Consensus   (251)  ESVKIECTRPNNKTRTSIRIGPGQAFYATGQVIGDIPEAYCNINESKWNE
                                      301                                              350
CH505TFchimSOSIP.664.v4.1G458Y  (301)
CH505TFchimSOSIP.664G458Y       (301)
CH505TFgp120G458Y               (298)
CH505TFgp140cG458Y              (298)
CH505TFgp160G458Y               (298)
                    Consensus   (301)  TLQRVSKKLKEYFPHKNITFQPSSGGDLEITTHSFNCGGEFFYCNTSSLF
                                      351                                              400
CH505TFchimSOSIP.664.v4.1G458Y  (351)
CH505TFchimSOSIP.664G458Y       (351)
CH505TFgp120G458Y               (348)
CH505TFgp140cG458Y              (348)
CH505TFgp160G458Y               (348)
                    Consensus   (351)  NRTYMANSTDMANSTETNSTETITIHCRIKQIINMWQEVGRAMYAPPIAG
                                      401                                              450
CH505TFchimSOSIP.664.v4.1G458Y  (401)
CH505TFchimSOSIP.664G458Y       (401)
CH505TFgp120G458Y               (398)
CH505TFgp140cG458Y              (398)
CH505TFgp160G458Y               (398)
                    Consensus   (401)  NITCISNITGLLLTRDGGKNNTETFRPGGGNMKDNWRSELYKYKVVEVKP
```

>HV1301236M5gp160G458Y atgtgggtgacggtgtactacggcgtgccggtgtggaaggaggccaagacgaccctgttctgcgcgtcggacgccaaggcctacgagaaggaggtgcac
aacgtgtgggcgacccacgcctgcgtgcccacggaccccaacccgcaggagatggtgctgaagaacgtgaccgagaacttcaacatgtggaagaacga
catggtggaccagatgcacgaggacgtgatctccctgtgggaccagtccctgaagcctgcgtgaagctgaccccgctgtgcgtgaccctgaactgcacc
aacgccaccgcgtccaactcctccatcatcgagggcatgaagaactgctccttcaacatcacgacggagctgcgcgacaagcgcgagaagaagaacgcc
ctgttctacaagctggacatcgtgcagctggacggcaactcctcgcagtacaggctgatcaactgcaacacctccgtcatcacgcaggcgtgccccaaggt
gtccttcgaccccatccccatccactactgcgcccccgccggctacgccatcctgaagtgcaacaacaagaccttcaccggcaccggcccgtgcaacaacg
tgtccaccgtgcagtgcacgcacgggatcaagcccgtggtgtccacgcagctgctcctgaacgggtcgctggccgagggcgagatcatcatccggtccga
gaacatcacgaagaacgtgaagaccatcatcgtgcacctgaacgagtccgtgaagatcgagtgcacccgcccgaacaacaagacgcgcacctccatccg
gatcggccctggccaggcctcctacgccaccggccaggtgatcggcgacatccgcgaggcgtactgcaacatcaacgagtccaagtggaacgagaccct
gcagcgcgtgtccaagaagctgaaggagtacttcccccacaagaacatcaccttccagccgtcgtccggcggcgacctcgagatcaccacgcactccttc
aactgcgcgtggcgagttcttctactgcaacacgtcgtcgctgttcaaccgcacctacatggccaactccaccgacatggccaactccaccgagaccaactc
cacgcgcaccatcacgatccactgccgcatcaagcagatcatcaacatgtggcaggaggtgggccgcgccatgtacgcaccgccatcgccggcaacat
cacctgcatctccaacatcaccggcctcctgctgacccgcgactacggcaagaacaacacggagaccttcaggccaggcggaggcaacatgaaggaca
actggcgctccgagctgtacaagtacaaggtggtggaggtgaagcccctgggcgtggcacccaccaacgcccgcaggcgcgtcgtggagcgcgagaag
cgcgccgtgggcatgggcgccgtgttcctgggcttcctgggcgctgcgggctccaccatgggtgccgcgtccatcccctgaccgtgcaggcccgccagct
gctctccggcatcgtgcagcagcagtccaacctcctgaaggccatcgaggcccagcagcacatgctgaagctgaccgtgtggggcatcaagcagctgcag
gccagggtgctcgcgctcgagcgctacctgaaggaccagcagctgctcggcatgtggggctgctccggcaagctgatctgcaccaccaacgtgtactgga
actcgtcctggtccaacaagaccctacgcgacatctgggacaacatgacctggatgcagtggggagcgcgagatctccaactacaccgagatcatctacga
gctcctcgaggagtcccagaaccagcaggagaagaacgagcaggatctgctcgcgctggaccgctggaactccctgtggaactggttcaacatcaccaa
ctggctgtggtacatcaagatcttcatcatgatcgtgggcggcctgatcggcctgcgcatcatcttcgccgtgctgtcgctggtgaaccgcgtgcgccaggg
ctactccccgctgtccctgcaaacgctgatcccctcccccgg cctccatccggatcggccctggccaggccttctacgccaccggccaggtgatcggcgacatccgcgaggcgtactgcaacatcaacgagtccaagtggaa
cgagaccctgcagcgcgtgtccaagaagctgaaggagtactcccccacaagaacatcaccttccagccgtcgtccggcggcgacctcgagatcaccacg
cactccttcaactgcggtggcgagttcttctactgcaacacgtcgtcgctgttcaaccgcacctacatggccaactccaccgacatggccaactccaccgag
accaactccacgcgcaccatcacgatccactgccgcatcaagcagatcatcaacatgtggcaggaggtgggccgcgccatgtacgcaccgcccatcgccg
gcaacatcacctgcatctccaacatcaccggcctcctgctgacccgcgactacggcaagaacaacacggagaccttcaggccaggcggaggcaacatga
aggacaactggcgctccgagctgtacaagtacaaggtggtggaggtgaagcccctgggcgtggcacccaccaacgcccgcaggcgcgtcgtggagcgc
gagaagcgcgccgtgggcatgggcgccgtgttcctgggcttcctgggcgctgcgggctccaccatgggtgccgcgtccatcaccctgaccgtgcaggcccg
ccagctgctctccggcatcgtgcagcagcagtccaacctcctgaaggccatcgaggcccagcagcacatgctgaagctgaccgtgtggggcatcaagcag
ctgcaggccagggtgctcgcgctcgagcgctacctgaaggaccagcagctgctcggcatgtggggctgctccggcaagctgatctgcaccaccaacgtgt
actggaactcgtcctggtccaacaagacctacggcgacatctgggacaacatgacctggatgcagtgggagcgcgagatctccaactacaccgagatcat
ctacgagctcctcgaggagtcccagaaccagcaggagaagaacgagcaggatctgctcgcgctggaccgctggaactccctgtggaactggttcaacat
caccaactggctgtggtacatcaagatcttcatcatgatcgtgggcggcctgatcggcctgcgcatcatcttcgccgtgctgtcgctggtgaaccgcgtgcg
ccagggctactccccgctgtccctgcaaacgctgatccccctccccccggggcccggacaggcccggtggcatcgaggaggagggcggcgagcaggaccg
caaccgctccacgcgcctggtgtccggcttcctggccctggtgtgggacgacctgcgctccctgtgcctgttcatctaccaccgcctgcgcgacttcatcctg
atcgcggcccgcgctggcgagctgctgggccggtcctcgctgaagggcctgcgccgcggctggaggccctgaagtacctgggctcgctggtgcagtact
ggggcctggagctgaagcgctccgccatctcctgctggacaccctggccatcgccgtgggcgagggcaccgaccgcatcctggagttcgtgctgggcatc
tgccgcgccatccgcaacatccccacccgcatccgccagggcttcgagaccgccctcctgtagtaa >HV1301237,CH505w020.14gp160G458Y
atgtggggtgacggtgtactacggcgtgccggtgtggaaggaggccaagacgacccctgttctgcgcgtcggacgccaaggcctacgagaaggaggtgcac
aacgtgtgggcgacccacgcctgcgtgcccacggaccccaacccgcaggagatggtgctgaagaacgtgaccgagaacttcaacatgtggaagaacga
catggtggaccagatgcacgaggacgtgatctccctgtgggaccagtccctgaagccctgcgtgaagctgaccccgctgtgcgtgaccctgaactgcacc
aacgccaccgcgtccaacaactccatcatcgagggcatgaagaactgctccttcaacatcacgacggagctgcgcgacaagcgcgagaagaagaacgc
cctgttctacaagctggacatcgtgcagctggacggcaactcctcgcagtacaggctgatcaactgcaacacctccgtcatcacgcaggcgtgccccaagg
tgtccttcgacccatccccatccactactgcgccccgccggctacgccatcctgaagtgcaacaacaagaccttcaccggcaccggcccgtgcaacaac
gtgtccaccgtgcagtgcacgcacgggatcaagcccgtggtgtccacgcagctgctcctgaacgggtcgctggccgagggcgagatcatcatccggtccg
agaacatcacgaacaacgcgaagaccatcatcgtgcacctgaacgagtccgtgaagatcgagtgcacccgccccgaacaacaagacgcgcacgtccatc
cggatcggccctggccaggccttctacgccaccggccaggtgatcggcgacatccgcaaggcgtactgcaacatctcggagtccaagtggaacgagacc
ctgcagcgcgtgtccaagaagctgaaggagtactcccccacaagaacatcaccttccagccgtcgtccggcggcgacctcgagatcaccacgcactcctt
caactgcggtggcgagttcttctactgcaacacgtcgtcgctgttcaaccgcacctacatggccaactccaccgacatggccaactccaccgagaccaact
ccacgcgcaccatcacgctccactgccgcatcaagcagatcatcaacatgtggcaggaggtgggccgcgccatgtacgcaccgcccatcgccggcaacat
cacctgcatctccaacatcaccggcctcctgctgacccgcgactacggcaagaacaacacggagaccttcaggccaggcggaggcaacatgaaggaca
actggcgctccgagctgtacaagtacaaggtggtggaggtgaagcccctgggcgtggcacccaccaacgcccgcaggcgcgtcgtggagcgcgagaag
cgcgccgtgggcatgggcgccgtgttcctgggcttcctgggcgctgcgggctccaccatgggtgccgcgtccatcaccctgaccgtgcaggcccgccagct
gctctccggcatcgtgcagcagcagtccaacctcctgaaggccatcgaggcccagcagcacatgctgaagctgaccgtgtggggcatcaagcagctgcag
gccagggtgctcgcgctcgagcgctacctgaaggaccagcagctgctcggcatgtggggctgctccggcaagctgatctgcaccaccaacgtgtactgga
actcgtcctggtccaacaagacctacggcgacatctgggacaacatgacctggatgcagtgggagcgcgagatctccaactacaccgagatcatctacga
gctcctcgaggagtcccagaaccagcaggagaagaacgagcaggatctgctcgcgctggaccgctggaactccctgtggaactggttcaacatcaccaa
ctggctgtggtacatcaagatcttcatcatgatcgtgggcggcctgatcggc

Figure 82 cont.

ctgcgcatcatcttcgccgtgctgtcgctggtgaaccgcgtgcgccagggctactccccgctgtccctgcaaacgctgatccctcccccggggcccggac
aggcccggtggcatcgaggaggagggcggcgagcaggaccgcaaccgctccacgcgcctggtgtccggcttcctggccctggtgtgggacgacctgcgc
tccctgtgcctgttcatctaccacgcctgcgcgacttcatcctgatcgcggcccgcgctggcgagctgctgggccggtcctcgctgaagggcctgcgccgc
ggctgggaggccctgaagtacctgggctcgctggtgcagtactggggcctggagctgaagcgctccgccatctccctgctggacaccctggccatcgccgt
gggcgagggcaccgaccgcatcctggagttcgtgctgggcatctgccgcgccatccgcaacatccccacccgcatccgccagggcttcgagaccgccctc
ctgtgatga >HV1301238,CH505.w30.12gp160G458Y atgtgggtgacggtgtactacggcgtgccggtgtggaaggaggccaagacgaccctgttctgcgcgtcggacgccaaggcctacgagaaggaggtgcac
aacgtgtgggcgacccacgcctgcgtgcccacggaccccaacccgcaggagatggtgctgaagaacgtgaccgagaacttcaacatgtggaagaacga
catggtggaccagatgcacgaggacgtgatctccctgtgggaccagtccctgaagccctgcgtgaagctgaccccgctgtgcgtgaccctgaactgcacc
aacgcgaccaacgccaccgcgtccaactcctccatcatcgagggcatgaagaactgctccttcaacatcacgacggagctgcgcgacaagcgcgagaag
aagaacgccctgttctacaagctggacatcgtgcagctggacgcaactcctcgcagtacaggctgatcaactgcaacacctccgtcatcacgcaggcgt
gccccaaggtgtccttcgaccccatccccatccactactgcgcccccgccggctacgccatcctgaagtgcaacaacaagaccttcaccggcaccggcccg
tgcaacaacgtgtccaccgtgcagtgcacgcacgggatcaagcccgtggtgtccacgcagctgctcctgaacgggtcgctggccgagggcgagatcatca
tccggtccgagaacatcacgaacaacgacaagaccatcatcgtgcacctgaacgagtccgtgaagatcgagtgcacccgcccgagcaacaagacgcg
acctccatccggatcggccctggccaggccttctacgccaccggccaggtgatcggcgacatccgcgaggcgtactgcaacatcagcgagtccaagtgga
acgagaccctgcagcgcgtgtccaagaagctgaaggagtacttcccccacaagaacatcaccttccagccgtcgtccggcggcgacctcgagatcaccac
gcactccttcaactgcggtggcgagttcttctactgcaacacgtcgtcgctgttcaaccgcacctacatggccaactccaccgacatggccaactccaccga
gaccaactccacgcgcaacatcacgatccactgccgcatcaagcagatcatcaacatgtggcaggaggtgggccgcgccatgtacgcaccgcccatcgc
cggcaacatcacctgcatctccaacatcaccggcctcctgctgacccgcgactacggcaagaacgacacggagaccttcaggccaggcggaggcaacat
gaaggacaactggcgcgctccgagctgtacaagtacaaggtggtggaggtgaagcccctgggcgtggcacccaccaacgcccgcaggcgcgtcgtggagc
gcgagaagcgcgccgtgggcatgggcgccgtgttcctgggcttcctgggcgctgcgggctccaccatgggtgccgcgtccatcaccctgaccgtgcaggcc
cgccagctgctctccggcatcgtgcagcagcagtccaacctcctgaaggccatcgaggcccagcagcacatgctgaagctgaccgtgtggggcatcaagc
agctgcaggccaggtgctcgcgctcgagcgctacctgaaggaccagcagctgctcggcatgtggggctgctccggcaagctgatctgcaccaccaacgt
gtactggaactcgtcctggtccaacaagacctacggcgacatctgggacaacatgacctggatgcagtgggagcgcgagatctccaactacaccgagatc
atctacgagctcctcgaggagtcccagaaccagcaggagaagaacgagcaggatctgctcgcgctggaccgctggaactccctgtggaactggttcaac
atcaccaactggctgtggtacatcaagatcttcatcatgatcgtgggcggcctgatcggcctgcgcatcatcttcgccgtgctgtcgctggtgaaccgcgtgc
gccagggctactccccgctgtccctgcaaacgctgatccctcccccggggcccggacaggcccggtggcatcgaggaggagggcggcgagcaggac
cgcaaccgctccacgcgcctggtgtccggcttcctggccctggtgtgggacgacctgcgctccctgtgcctgttcatctaccacgcctgcgcgacttcatcc
tgatcgcggcccgcgctggcgagctgctgggccggtcctcgctgaagggcctgcgccgcggctgggaggccctgaagtacctgggctcgctggtgcagta
ctggggcctggagctgaagcgctccgccatctccctgctggacaccctggccatcgccgtgggcgagggcaccgaccgcatcctggagttcatcctgggca
tctgccgcgccatccgcaacatccccacccgcatccgccagggcttcgagaccgccctcctgtgatga >HV1301239,CH505w30.20gp160G458Y atgtgggtgacggtgtactacggcgtgccggtgtggaaggaggccaagacgaccctgttctgcgcgtcggacgccaaggcctacgagaaggaggtgcac
aacgtgtgggcgacccacgcctgcgtgcccacggaccccaacccgcaggagatggtgctgaagaacgtgaccgagaacttcaacatgtggaagaacga
catggtggaccagatgcacgaggacgtgatctccctgtgggaccagtccctgaagccctgcgtgaagctgaccccgctgtgcgtgaccctgaactgcacc
aacgcgacgaccaacgccaccgcgtccaactcctccatcatcgagggcatgaagaactgctccttcaacatcacgacggagctgcgcgaca

Figure 82 cont.

agcgcgagaagaagaacgccctgttctacaagctggacatcgtgcagctggacggcaactcctcgcagtacaggctgatcaactgcaacacctccgtcat
cacgcaggcgtgccccaaggtgtccttcgaccccatccccatccactactgcgccccgccggctacgccatcctgaagtgcaacaacaagaccttcaccg
gcaccggcccgtgcaacaacgtgtccaccgtgcagtgcacgcacgggatcaagcccgtggtgtccacgcagctgctcctgaacgggtcgctggccgaggg
cgagatcatcatccggtccgagaacatcacgaacaacgcgaagaccatcatcgtgcacctgaacgagtccgtgaagatcgagtgcacccgcccgaacaa
caagacgcgcacctccatccggatcggccctggccaggccttctacgccaccggccaggtgatcggcgacatccgcgaggcgtactgcaacatcagcgag
tccaagtggaacgagaccctgcagcgcgtgtccaagaagctgaaggagtacttccccgacaagaacatcaccttccagccgtcgtccggcggcgacctcg
agatcaccacgcactccttcaactgcggtggcgagttcttctactgcaacacgtcgtcgctgttcaaccgcacctacatggccaactccaccgacatggcca
actccaccgagaccaactccacgcgcatcatcacgatccactgccgcatcaagcagatcatcaacatgtggcaggaggtggccgcgccatgtacgcacc
gcccatcgccggcaacatcacctgcatctccaacatcaccggcctcctgctgacccgcgactacggcaagaacacgagggacggaggcaagaacaacac
ggagaccttcaggccaggcggaggcaacatgaaggacaactggcgctccgagctgtacaagtacaaggtggtggaggtgaagcccctgggcgtggcac
ccaccaacgcccgcaggcgcgtcgtggagcgcgagaagcgcgccgtgggcatgggcgccgtgttcctgggcttcctgggcgctgcgggctccaccatggg
tgccgcgtccatcaccctgaccgtgcaggcccgccagctgctctccggcatcgtgcagcagcagtccaacctcctgaaggccatcgaggcccagcagcac
atgctgaagctgaccgtgtggggcatcaagcagctgcaggccagggtgctcgcgctcgagcgctacctgaaggaccagcagctgctcggcatgtggggct
gctccggcaagctgatctgcaccaccaacgtgtactggaactcgtcctggtccaacaagacctacggcgacatctgggacaacatgacctggatgcagtg
ggagcgcgagatctccaactacaccgagatcatctacgagctcctcgaggagtcccagaaccagcaggagaagaacgagcaggatctgctcgcgctgg
accgctggaactccctgtggaactggttcaacatcaccaactggctgtggtacatcaagatcttcatcatgatcgtgggcggcctgatcggcctgcgcatca
tcttcgccgtgctgtcgctggtgaaccgcgtgcgccagggctactccccgctgtccctgcaaacgctgatccctccccccggggcccggacaggcccggtg
gcatcgaggaggagggcggcgagcaggaccgcaaccgctccacgcgcctggtgtccggcttcctggccctggcgtgggacgacctgcgctccctgtgcct
gttcatctaccaccgcctgcgcgacttcatcctgatcgcggcccgcgctggcgagctgctgggccggtcctcgctgaagggcctgcgccgcggctgggagg
ccctgaagtacctgggctcgctggtgcagtactggggcctggagctgaagcgctccgccatctccctgctggacaccctggccatcgccgtgggcgagggc
accgaccgcatcctggagttcgtgctgggcatctgccgcgcgccatccgcaacatccccacccgcatccgccagggcttcgagaccgccctcctgtgatga >CH505w136.B18gp160G458Y atgtgggtgacggtgtactacggcgtgccggtgtggaaggaggccaagacgaccctgttctgcgcgtcggacgccaaggcctacgagaaggaggtgcac
aacgtgtgggcgacccacgcctgcgtgcccacggaccccaacccgcaggagatggtgctgaagaacgtgaccgagaacttcaacatgtggaagaacga
catggtggaccagatgcacgaggacgtgatctccctgtgggaccagtccctgacgcccgtgtgaagctgaccccgctgtgcgtgaccctgaactgcacg
gacgccaacgacaccgcgtcgaacagctccatcatcaaggggatgaacaactccatcgtggggagatgaagaactgctccttcaacatcacgacggag
ctgcgcgacaagcgcgagaagaagaacgccctgttctacaagctggacatcgtgcagctggacggcaactcctcggagtacaggctgatcaactgcaac
acctccgtcatcacgcaggcgtgccccaaggtgtccttcgaccccatccccatccactactgcgccccgccggctacgccatcctgaagtgcaacaacaa
gaccttcaacggcaccggcccgtgcaacaacgtgtccaccgtgcagtgcacgcacgggatcaagcccgtggtgtccacgcagctgctcctgaacgggtcg
ctggccgagggcgagatcatcatccggtcggagaacatcacggacaacgcgaagaccatcatcgtgcacctgaacgagtccgtgaagatcgagtgcacc
cgcccgagcaacaacacgcgcacctccatccggatcggccctggccaggccttctacgccaccggccaggtgatcggcgacatccgcaaggcgcactgc
aacatctccgagtccaagtggaacgagaccctgcagcgcgtgtccaagaagctgaaggagtacttccccgacaagaacatcaccttccagccgtcgtccg
gcggcgaccccgagatcaccacgcactccttcaactgcggtggcgagttcttctactgcaacacgtcgtccctgttcaaccgcacctacatggccaactcga
cggacatggccgaactccgcggagaccaactccacgcgcaccatcacgctccactgccgcatcaagcagatcatcaacatgtggcaggaggtgggccgcg
ccatgtacgcaccgcccatcgccggcaacatcacctgcatctccaacatcaccggcctcctgctgacccgcgactacggcaactccagcacggagacgga
gaccttcaggccaggggggaggcaacatgaaggacaactggcgctccgagctgtacaagtacaaggtggtggaggtgaagcccctgggcgtggcaccca
ccaacgcccgcaggcgcgtggtggagcgcgagaagcgcgccgtgggcatgggcgccgtgttcctgggcttcctgggcgctgcgggctccaccatgggtgc
cgcgtccatcaccctgaccgtgcaggcccgccagctgctctccggcatcgtgcagcagcagt

Figure 82 cont.

ccaacctcctgaaggccatcgaggcccagcagcacatgctgcggctgaccgtgtggggcatcaagcagctgcaggccagggtgctcgcgctcgagcgct
acctgaaggaccagcagctgctcggcatgtggggctgctccggcaagctgatctgcaccaccaacgtgtactggaactcgtcctggtccaacaagaccta
cgacgacatctgggacaacatgacctggatgcagtgggaggggagatctccaactacaccaacatcatctacgacctcctcgaggagtcccagaaccaa
gcaggagaagaacgagcaggatctgctcgcgctggaccgctggaactccctgtggaactggttcaacatcaccaactggctgtggtacatcaagatcttc
atcatgatcgtgggcggcctgatcggcctgcgcgatcatcttcgccgtgctgtcgctggtgaaccgcgtgcgccagggctactccccgctgtccctgcaaacg
ctgatcccctccccggggcccggacaggcccgtggcatcgaggaggaggcggcgagcaggaccgcaagcgctccacgcgcctggtgtccggcttc
ctggccctggtgtgggacgacctgcgctccctgtgcctgttcctctaccaccgcctgcgcgacttcatcctgatcgcggcccgcgctggcgagctgctgggcc
ggtcctcgctgaagggcctgcgccgcggctgggaggccctgaagtacctgggcagcctggtgcagtactggggcctggagctgaagcgctccgccatctc
cctgctggacaccctggccatcgccgtgggcgagggcaccgaccgcatcctggagttcgtgctgggcatctgccgcgccatccgcaacatccccacccgca
tccgccagggcttcgagaccgccctcctgtagtaa

>CH505TFgp160G458Y atgtgggtgacggtgtactacggcgtgccggtgtggaaggaggccaagacgaccctgttctgcgcgtcggacgccaaggcctacgagaaggaggtgcac
aacgtgtgggcgacccacgcctgcgtgcccacggaccccaacccgcaggagatggtgctgaagaacgtgaccgagaacttcaacatgtggaagaacga
catggtggaccagatgcacgaggacgtgatctccctgtgggaccagtccctgaagcctgcgtgaagctgaccccgctgtgcgtgaccctgaactgcacc
aacgccaccgcgtccaactcctccatcatcgagggcatgaagaactgctccttcaacatcacgacggagctgcgcgacaagcgcgagaagaagaacgcc
ctgttctacaagctggacatcgtgcagctggacggcaactcctcgcagtacaggctgatcaactgcaacacctccgtcatcacgcaggcgtgccccaaggt
gtccttcgaccccatccccatccactactgcgcccccgccggctacgccatcctgaagtgcaacaacaagaccttcaccggcaccggcccgtgcaacaacg
tgtccaccgtgcagtgcacgcacgggatcaagcccgtggtgtccacgcagctgctcctgaacgggtcgctggccgagggcgagatcatcatccggtccga
gaacatcacgaacaacgtgaagaccatcatcgtgcacctgaacgagtccgtgaagatcgagtgcacccgcccgaacaacaagacgcgcacctccatccg
gatcggccctggccaggccttctacgccaccggccaggtgatcggcgacatccgcgaggcgtactgcaacatcaacgagtccaagtggaacgagaccct
gcagcgcgtgtccaagaagctgaaggagtacttcccccacaagaacatcaccttccagccgtcgtccggcggcgacctcgagatcaccacgcactccttc
aactgcggtggcgagttcttctactgcaacacgtcgtcgctgttcaaccgcacctacatggccaactccaccgacatggccaactccaccgagaccaactc
cacgcgcaccatcacgatccactgccgcatcaagcagatcatcaacatgtggcaggaggtggccgcgccatgtacgccgcccatcgccggcaacat
cacctgcatctccaacatcaccggcctcctgctgacccgcgactacggcaagaacaacacggagaccttcaggccaggcggaggcaacatgaaggaca
actggcgctccgagctgtacaagtacaaggtggtggaggtgaagcccctgggcgtggcacccaccaacgcccgcaggcgcgtcgtggagcgcgagaag
cgcgccgtgggcatgggcgccgtgttcctgggcttcctgggcgctgcgggctccaccatgggtgccgcgtccatcaccctgaccgtgcaggcccgccagct
gctctccggcatcgtgcagcagcagtccaacctcctgaaggccatcgaggcccagcagcacatgctgaagctgaccgtgtggggcatcaagcagctgcag
gccagggtgctcgcgctcgagcgctacctgaaggaccagcagctgctcggcatgtgggctgctccggcaagctgatctgcaccaccaacgtgtactgga
actcgtcctggtccaacaagacctacgcgacatctgggacaacatgacctggatgcagtgggagcgcgagatctccaactacaccgagatcatctacga
gctcctcgaggagtcccagaaccagcaggagaagaacgagcaggatctgctcgcgctggaccgctggaactccctgtggaactggttcaacatcaccaa
ctggctgtggtacatcaagatcttcatcatgatcgtgggcggcctgatcggcctgcgcatcatcttcgccgtgctgtcgctggtgaaccgcgtgcgccaggg
ctactccccgctgtccctgcaaacgctgatcccctccccggggcccggacaggcccgtggcatcgaggaggaggcggcgagcaggaccgcaaccg
ctccacgcgcctggtgtccggcttcctggccctggtgtgggacgacctgcgctccctgtgcctgttcatctaccaccgcctgcgcgacttcatcctgatcgcg
gcccgcgctggcgagctgctgggccggtcctcgctgaagggcctgcgccgcggctgggaggccctgaagtacctgggctcgctggtcagtactggggcc
tggagctgaagcgctccgccatctccctgctggacaccctggccatcgccgtgggcgagggcaccgaccgcatcctggagttcgtgctgggcatctgccgc
gccatccgcaacatccccacccgcatccgcagggcttcgagaccgccctcctgtag

Figure 82 cont.

\>HV1301005CH505week53.16gp160G458Y
atgtgggtgacggtgtactacggcgtgccggtgtggaaggaggccaagacgaccctgttctgcgcgtcggacgccaaggcctacgagaaggaggtgcac
aacgtgtgggcgacccacgcctgcgtgcccacggaccccaacccgcaggagatggtgctgaagaacgtgaccgagaacttcaacatgtggaagaacga
catggtggaccagatgcacgaggacgtgatctccctgtgggaccagtccctgaagccctgcgtgaagctgaccccgctgtgcgtgaccctgaactgcacc
aacgcgaacgccaccgcgtccaactcctctatcatcgaggggatgaactcctccatcatcgagggcatgaagaactgctccttcaacatcacgacggagc
tgcgcgacaagcgcgagaagaagaacgccctgttctacaagctggacatcgtgcagctggacggcaactcctcgcagtacaggctgatcaactgcaaca
cctccgtcatcacgcaggcgtgccccaaggtgtccttcgaccccatccccatccactactgcgccccgccggctacgccatcctgaagtgcaacaacaag
accttcaacggcaccggcccgtgcaacaacgtgtccaccgtgcagtgcacgcacgggatcaagcccgtggtgtccacgcagctgctcctgaacgggtcgc
tggccgagggcgagatcatcatccggtccgagaacatcacggacaacgggaagaccatcatcgtgcacctgaacgagtccgtgaagatcgagtgcaccc
gcccgagcaacaacacgcgcacctccatccggatcggccctggccaggccttctacgccaccggccaggtgatcggcgacatccgcgaggcgcactgca
acatctcggagtccaagtggaacgagaccctgcagcgcgtgtccgagaagctgaaggagtacttccccacaagaacatcaccttccagccgtcgtccgg
cggcgacctcgagatcaccacgcactccttcaactgcggtggcgagttcttctactgcaacacgtcgtcgctgttcaaccgcacctacatggccacgtccac
cgacatggccaactccaccgagaccaactccacgcgcatcatcacgatccggtgccgcatcaagcagatcatcaacatgtggcaggaggtgggccgcgc
catgtacgcaccgcccatcgccggcaacatcacctgcatctccaacatcaccggcctcctgctgacccgcgactacggcaagaacaacacggagacc ttc
gagacgttcaggccaggcggaggcaacatgaaggacaactggcgctccgagctgtacaagtacaaggtggtggaggtgaagccc ctgggcgtggcacc
caccaacgcccgcaggcgcgtcgtggagcgcgagaagcgcgccgtgggcatgggcgccgtgttcctgggcttcctgggcgctgcgggctccaccatgggt
gccgcgtccatcacc ctgaccgtgcaggcccgccagctgctctccggcatcgtgcagcagcagtccaacctcctgaaggccatcgaggcccagcagcaca
tgctgaagctgaccgtgtggggcatcaagcagctgcaggccagggtgctcgcgctcgagcgctacctgaaggaccagcagctgctcggcatgtggggctg
ctccggcaagctgatctgcaccaccaacgtgtactggaactcgtcctggtccaacaagacctacgcgacatctgggacaacatgacctggatgcagtgg
gagcgcgagatctccaactacaccgagatcatctacgagctcctcgaggagtcccagaaccagcaggagaagaacgagcaggatctgctcgcgctggac
cgctggaactccctgtggaactggttcaacatcaccaactggctgtggtacatcaagatcttcatcatgatcgtgggcggcctgatcggcctgcgcatcatc
ttcgccgtgctgtcgctggtgaaccgcgtgcgccaggg ctactccccgctgtccctgcaaacgctgatccctcccccggggcccggacaggcccggtgg
catcgaggaggagggcggcgagcaggaccgcaaccgctccacgcgcctggtgtccggcttcctggccctggcgtgggacgacctgcgctccctgtgcctg
ttcatctaccaccgcctgcgcgacttcatcctgatcgcggcccgcgctggcgagctgctgggccggtcctcgctgaagggcctgcgccgcggctgggaggc
cctgaagtacctgggctcgctggtgcagtactggggccctggagctgaagcgctccgccatctccctgctggacaccctggccatcgccgtgggcgagggca
ccgaccgcatcctggagttcgtgctgggcatctgccgcgccatccgcaacatccccacccgcatccgccagggcttcgagaccgccctcctgtag

Figure 82 cont.

… # COMPOSITIONS COMPRISING MODIFIED HIV ENVELOPES

This application is a U.S. National Stage application under 35 U.S.C. § 371 of International Patent Application No. PCT/US2018/34772, filed on May 25, 2018, which claims the benefit of and priority to U.S. Provisional Application No. 62/511,226 filed May 25, 2017 and U.S. Provisional Application No. 62/565,952 filed Sep. 29, 2017, the contents of each of which are hereby incorporated by reference in their entireties.

SEQUENCE LISTING

The instant application contains a Sequence Listing which has been filed electronically in ASCII format and is hereby incorporated by reference in its entirety. Said ASCII copy, created on Apr. 10, 2020, is named 1234300 00334US2 SL.txt and is 1,617,443 bytes in size.

TECHNICAL FIELD

The present invention relates in general, to a composition suitable for use in inducing anti-HIV-1 antibodies, and, in particular, to immunogenic compositions comprising envelope proteins and nucleic acids to induce cross-reactive neutralizing antibodies and increase their breadth of coverage. The invention also relates to methods of inducing such broadly neutralizing anti-HIV-1 antibodies using such compositions.

BACKGROUND

The development of a safe and effective HIV-1 vaccine is one of the highest priorities of the scientific community working on the HIV-1 epidemic. While anti-retroviral treatment (ART) has dramatically prolonged the lives of HIV-1 infected patients, ART is not routinely available in developing countries.

SUMMARY OF THE INVENTION

The ability to stimulate germline B cells that give rise to broadly neutralizing antibodies (bNAbs) is a major goal for HIV-1 vaccines. BNAbs that target the CD4-binding site (CD4bs) of HIV-1 and exhibit extraordinary potency and breadth of neutralization are particularly attractive to elicit with vaccines. Glycans that border the CD4bs and impede the binding of germline-reverted forms of CD4bs bNAbs are potential barriers to naïve B cell receptor engagement. In some aspects, pseudovirus neutralization was used as a means to identify Env modifications that permit native Env trimer binding to germline reverted CD4bs bNAb CH235.12 (VH1-46) as a surrogate for naïve B cell receptor engagement.

Site-directed mutagenesis was used to create strategic mutants of autologous CH0505TF Env. The mutants were produced in cells lacking the enzyme N-acetylglucosaminyltransferase (GnTI-) to enrich for Man5 glycoforms of N-linked glycans that would otherwise be fully processed into complex-type glycans. Naturally-glycosylated and Man5-enriched forms of parental and mutant Envs were tested for neutralization by the CH235 antibody lineage that included the unmutated common ancestor (UCA), intermediates and mature forms of CH235.12. Corresponding SOSIP.664 trimers were tested for UCA binding. These strategies are used to create germline-targeting and reverse-engineered immunogens to Elicit CH235.12 Lineage BNAbs.

In one aspect the invention provides that Man5-enriched CH0505TF containing two VRC01-class resistance mutations, N279K (loop D) and G458Y (V5 region), was highly susceptible to neutralization by CH235 UCA. This double mutant was also neutralized by the UCA when produced in 293T cells but was 100× more sensitive when produced in GnTI-cells (Man5-enrichment). Neutralization predicted nM affinity binding to various envelopes, e.g. but not limited to mutated, Man5-enriched CH0505TF SOSIP.664 trimers.

In one aspect the invention provides recombinant HIV-1 envelope polypeptides from Tables 1A-B, Examples 2-13, or any other envelope, wherein the envelope comprises G458Mut. In some embodiments, optionally the polypeptide is enriched for Man5 glycoforms of N-linked glycans. In certain embodiments G458Mut is G458Y. In certain embodiments non-limiting embodiments of G458Mut are described in Ex. 10 and FIG. 89. In the embodiments where the polypeptide is not enriched for Man5 glycoforms of N-linked glycans, the polypeptide is recombinantly produced in any suitable cell line wherein the polypeptide is fully glycosylated compared to the enrichment for Man5 glycoforms of N-linked glycans in GnTI-/- cells. In one embodiment, 293T cells are used to produce fully or naturally glycosylated polypeptides. Other cells may be used in place of 293T cells to produce naturally or fully glycosylated immunogens.

In one aspect, the invention provides a recombinant HIV-1 envelope polypeptide from Tables 1A-B, Examples 2-13, or any other envelope, wherein the polypeptide is enriched for Man5 glycoforms of N-linked glycans, and wherein in some embodiments the polypeptide has differential binding and/neutralization compared to fully glycosylated envelope.

In one aspect the invention provides a nucleic acid encoding the recombinant polypeptides of the invention.

In one aspect the invention provides a recombinant trimer comprising three identical protomers of an HIV-1 envelope polypeptide of the invention. In one aspects the invention provides an immunogenic composition comprising the recombinant trimer of the invention and a carrier, wherein the trimer comprises three identical protomers of an HIV-1 envelope polypeptide. In certain embodiments, the composition comprises which are substantially homogenous.

In one aspect the invention provides an immunogenic composition comprising nucleic acid encoding the recombinant HIV-1 envelope polypeptide of the invention and a carrier.

In certain embodiments, the recombinant HIV-1 envelope polypeptide is HIV-1 CH505 M5. In certain embodiments, the recombinant HIV-1 envelope polypeptide is HIV-1 CH505 T/F. In certain embodiments, the recombinant HIV-1 envelope polypeptide is HIV-1 CH505 M11.

In one aspect the invention provides methods of using the immunogens of the invention to induce immune response, wherein in some embodiments without limitation these immune responses stimulate germline B cells that give rise to broadly neutralizing antibodies (bNAbs). Non-limiting embodiments of methods are described in FIGS. 58A and 58B. In one aspect the invention provides methods of inducing an immune response in a subject comprising administering a composition comprising any suitable form of an HIV-1 envelope(s) in an amount sufficient to induce an immune response from one or more of the envelopes of the preceding paragraphs, wherein in one embodiment the envelope is: (a) envelope CH505 M5 G458Mut, (b) envelope CH505 M5, wherein the envelope is enriched for Man5 glycoforms of N-linked glycans; (c) CH 505 M5 G458Mut, wherein the envelope is enriched for Man5 glycoforms of N-linked glycans, or any combination thereof.

Any one of the methods of the invention wherein the administration step can alternatively, or in addition, comprise administering a nucleic acid encoding the corresponding HIV-1 polypeptide(s) in an amount sufficient to induce an immune response.

Any one of the methods of the invention wherein the method comprises administering a composition comprising HIV-1 envelope CH505 M5 G458Mut or a nucleic acid encoding HIV-1 envelope CH505 M5 G458Mut.

Any one of the methods of the invention further comprising administering a composition comprising HIV-1 envelope CH505 M5, wherein the envelope is enriched for Man5 glycoforms of N-linked glycans.

Any one of the methods of the invention further comprising administering a composition comprising HIV-1 envelope CH505 M5 G458Mut, wherein the envelope is enriched for Man5 glycoforms of N-linked glycans wherein the envelope is enriched for Man5 glycoforms of N-linked glycans.

Any one of the methods of the invention wherein the method comprises administering a composition comprising HIV-1 envelope CH505 M5 G458Mut, wherein the envelope is enriched for Man5 glycoforms of N-linked glycans.

Any one of the methods of the invention further comprising administering a composition comprising CH505 M5, wherein the envelope is enriched for Man5 glycoforms of N-linked glycans Any one of the methods of the invention further comprises administering a composition comprising HIV-1 envelope CH505 M5 G458Mut or a nucleic acid encoding HIV-1 envelope CH505 M5 G458Mut.

Any one of the methods of the invention further comprising administering a composition comprising HIV-1 envelope CH505 T/F, wherein the envelope is enriched for Man5 glycoforms of N-linked glycans.

Any one of the methods of the invention further comprising administering a composition comprising HIV-1 envelope CH505 M5, wherein the envelope is enriched for Man5 glycoforms of N-linked glycans and HIV-1 envelope CH505 M5 G458Mut, wherein the envelope is enriched for Man5 glycoforms of N-linked glycans.

Any one of the methods of the invention further comprising administering a composition comprising HIV-1 envelope CH505 M5 and HIV-1 envelope CH505 M5 G458Mut.

Any one of the methods of the invention further comprising administering a composition comprising HIV-1 envelope CH505 T/F, wherein the envelope is enriched for Man5 glycoforms of N-linked glycans.

Any one of the methods of the invention further comprising administering a composition comprising HIV-1 envelope CH 505 T/F.

Any one of the methods of the invention wherein the polypeptide is gp120 envelope, gp120D8 envelope, a gp140 envelope (gp140C, gp140CF, gp140CFI) as soluble or stabilized protomer of a SOSIP trimer, a gp145 envelope, a gp150 envelope, or a transmembrane bound envelope.

Any one of the methods or compositions of the invention wherein the composition further comprises an adjuvant.

Any one of the methods of the invention further comprising administering an agent which modulates host immune tolerance.

Any one of the methods or compositions of the invention wherein the polypeptide administered is multimerized. Non-limiting embodiments of multimerized envelopes include ferritin particles, liposomes, nanoparticles, or any other suitable form.

Any one of the methods of the invention further comprising administering an additional immunogen. Non-limiting embodiments are described Example 2-13.

In some aspects, these findings advance our understanding of the restrictions imposed by glycans in the elicitation of CD4bs bNAbs and provide a conceptual framework and methods for immunogen design to initiate and mature the CH235.12 bNAb lineage.

In one aspect, the invention is directed to immunogens and methods for germline B cell stimulation and maturation by reverse engineering of HIV-1 envelopes. B cell stimulation is a key initial step in the ability of HIV vaccines to elicit broadly neutralizing antibodies (bNAbs). In some aspects the invention provides modifications of HIV-1 envelopes to trigger germline activation and drive subsequent B cell maturation of bNAbs, including but not limited to CD4bs bNAbs.

In certain aspects, the invention is directed to a recombinant HIV-1 envelope polypeptide, including but not limited to an envelope from Tables 1A-B, wherein the envelope comprises G458Mut and/or glycosylation pattern similar to the glycosylation patter of an envelope grown in GnTI$^{-/-}$ cells. In certain embodiments, the polypeptide is a non-naturally occurring protomer designed to form an envelope trimer. The glycosylation pattern of GnTI−/− grown recombinant polypetides is well known. In some embodiments, when produced in GnTI−/− cells the polypeptides are enriched for Man5 glycoforms of N-linked glycans.

In certain aspects, the invention provides nucleic acids encoding these recombinant polypeptides. In certain aspects, the invention provides recombinant cells and/or population of recombinant cells comprising nucleic acids encoding the recombinant polypeptides of the invention.

In certain embodiments, the invention provides a recombinant trimer comprising three identical protomers of an envelope from Tables 1A-B. In certain embodiments, the invention provides an immunogenic composition comprising the recombinant trimer and a carrier, wherein the trimer comprises three identical protomers of an HIV-1 envelope listed in Tables 1A-B.

In certain embodiments, the invention provides an immunogenic composition comprising nucleic acid encoding a recombinant HIV-1 envelope and a carrier. The compositions could comprise an adjuvant.

In certain embodiments the recombinant envelope is HIV-1 envelope CH505 M5 or a nucleic acid encoding HIV-1 envelope CH505M5, wherein the HIV-1 CH505 M5 envelope comprises a G458Mut and is recombinantly produced in 293T cells so that glycosylation pattern is not Man5 enriched. In certain embodiments the recombinant envelope is HIV-1 envelope CH505 M5 or a nucleic acid encoding HIV-1 envelope CH505 M5, wherein the HIV-1 CH505 M5 envelope does not comprise a G458Mut and is recombinantly produced in GnTI−/− cells so that glycosylation pattern is Man5 enriched. In certain embodiments the recombinant envelope is HIV-1 envelope CH505 M5 or a nucleic acid encoding HIV-1 envelope CH505 M5, wherein the HIV-1 CH505 M5 envelope comprises a G458Mut and is recombinantly produced in GnTI−/− cells so that glycosylation pattern is Man5 enriched.

In certain embodiments the recombinant envelope is HIV-1 envelope CH505 M11 or a nucleic acid encoding HIV-1 envelope CH505 M11, wherein the HIV-1 CH505 M11 envelope comprises a G458Mut and is recombinantly produced in 293T cells so that glycosylation pattern is not Man5 enriched. In certain embodiments the recombinant envelope is HIV-1 envelope CH505 M11 or a nucleic acid encoding HIV-1 envelope CH505 M11, wherein the HIV-1 M11 envelope does not comprise a G458Mut and is recombinantly produced in GnTI−/− cells so that glycosylation pattern is Man5 enriched. In certain embodiments the recombinant envelope is HIV-1 envelope CH505 M11 or a nucleic acid encoding HIV-1 envelope CH505 M11, wherein the HIV-1 CH505 M11 envelope comprises a G458Mut and is recombinantly produced in GnTI−/− cells so that glycosylation pattern is Man5 enriched.

In certain embodiments the recombinant envelope is HIV-1 envelope CH505 T/F or a nucleic acid encoding HIV-1 envelope CH505 T/F, wherein the HIV-1 CH505 T/F envelope comprises a G458Mut and is recombinantly produced in 293T cells so that glycosylation pattern is not Man5 enriched. In certain embodiments the recombinant envelope is HIV-1 envelope CH505 T/F or a nucleic acid encoding HIV-1 envelope CH505 T/F, wherein the HIV-1 CH505 T/F envelope does not comprise a G458Mut and is recombinantly produced in GnTI−/− cells so that glycosylation pattern is Man5 enriched. In certain embodiments the recombinant envelope is HIV-1 envelope CH505 T/F or a nucleic acid encoding HIV-1 envelope v, wherein the HIV-1 CH505 T/F 5 envelope comprises a G458Mut and is recombinantly produced in GnTI−/− cells so that glycosylation pattern is Man5 enriched.

In certain aspects the invention provides methods of inducing immune responses using the inventive immunoges. In one embodiment the invention provides a method of inducing an immune response in a subject comprising administering a composition in an amount sufficient to induce an immune response, wherein the composition comprises any suitable form of a nucleic acid(s) encoding an HIV-1 envelope(s) from one or more of the following groups:
 (a) envelopesCH505 M5, M11, w20.14, w30.20, w30.12, and w136.B18 (Selection F, e.g. listed in FIG. 18A) or any combination thereof;
 (b) envelopes CH505 M5, w30.25, w53.25, and w53.29 (Selection G, e.g. FIG. 20) or any combination thereof;
 (c) envelopes CH505 M5, w30.20, w20.14, and w30.12 (Selection H, e.g. FIG. 21) or any combination thereof,
 and wherein the administration step can alternatively, or in addition, comprise administering an HIV-1 polypeptide(s) in an amount sufficient to induce an immune response from one or more of the following groups:
 (a) envelopes CH505 M5, M11, w20.14, w30.20, w30.12, and w136.B18 (Selection F, e.g. listed in FIG. 18A) or any combination thereof;
 (b) envelopes CH505 M5, w30.25, w53.25, and w53.29 (Selection G, e.g. FIG. 20) or any combination thereof;
 (c) envelopes CH505 M5, w30.20, w20.14, and w30.12 (Selection H, e.g. FIG. 21) or any combination thereof;
 Wherein in some embodiments the envelopes comprise G458Mut and/or in some embodiments have glycosylation pattern similar to the glycosylation patter of an envelope grown in GnTI$^{-/-}$ cells.

In certain embodiments the methods comprise administering immunogens with increasing BCR stimulation (See e.g. FIG. 58). In certain embodiments the methods comprise administering recombinant HIV-1 envelope CH505 M5 or a nucleic acid encoding HIV-1 envelope CH505M5, wherein the HIV-1 CH505 M5 envelope comprises a G458Mut and is recombinantly produced in 293T cells so that glycosylation pattern is not Man5 enriched. In certain embodiments the methods comprising the recombinant envelope is HIV-1 envelope CH505 M5 or a nucleic acid encoding HIV-1 envelope CH505 M5, wherein the HIV-1 CH505 M5 envelope does not comprise a G458Mut and is recombinantly produced in GnTI−/− cells so that glycosylation pattern is Man5 enriched. In certain embodiments the methods comprise administering the recombinant envelope is HIV-1 envelope CH505 M5 or a nucleic acid encoding HIV-1 envelope CH505 M5, wherein the HIV-1 CH505 M5 envelope comprises a G458Mut and is recombinantly produced in GnTI−/− cells so that glycosylation pattern is Man5 enriched.

In some embodiments the methods further comprise administering HIV-1 envelope w20.14 or a nucleic acid encoding HIV-1 envelope w20.14, followed by administering HIV-1 envelope w30.20 or a nucleic acid encoding HIV-1 envelope w30.20, and followed by administering HIV-1 envelope w30.12 or a nucleic acid encoding HIV-1 envelope w30.12.

In some embodiments the methods further comprise administering HIV-1 envelope w136.B18 or a nucleic acid encoding HIV-1 envelope w136.B18.

In some embodiments the methods further comprise administering HIV-1 envelope w30.25 or a nucleic acid encoding HIV-1 envelope w30.25, HIV-1 envelope w53.25 or a nucleic acid encoding HIV-1 envelope w53.25, HIV-1 envelope w53.29 or a nucleic acid encoding HIV-1 envelope w53.29.

A method of inducing an immune response in a subject comprising administering a composition in an amount sufficient to induce an immune response, wherein the composition comprises any suitable form of a nucleic acid(s) encoding an HIV-1 envelope(s) in an amount sufficient to induce an immune response from one or more of the following groups:
 (a) envelopes CH 505 T/F, M5, w53.16, w78.33, and w100.B6 or any combination thereof; wherein the envelopes comprise G458Mut,
 and wherein the administration step can alternatively, or in addition, comprise administering an HIV-1 polypeptide(s) in an amount sufficient to induce an immune response from one or more of the following groups:
 (a) envelopes CH 505 T/F, M5, w53.16, w78.33, and w100.B6 or any combination thereof; wherein the envelopes comprise G458Mut and/or glycosylation pattern similar to the glycosylation patter of an envelope grown in GnTI$^{-/-}$ cells.

In certain embodiments, the invention provides compositions and method for induction of immune response, for example cross-reactive (broadly) neutralizing Ab induction. In certain embodiments, the methods use compositions comprising "swarms" of sequentially evolved envelope viruses that occur in the setting of bnAb generation in vivo in HIV-1 infection.

In certain aspects the invention provides modified HIV envelopes, wherein the modified envelopes are suitable for use as immunogens for germline targeting of CD4bs broadly neutralizing antibodies. In certain aspects, the modified envelopes of the invention could be used in assays to determine whether CD4bs broad neutralization antibodies lineage(s) have been induced by vaccine regimens.

In certain aspects the invention provides compositions comprising a selection of HIV-1 envelopes and/or nucleic acids encoding these envelopes as described herein for example but not limited to Selections as described herein. Without limitations, these selected combinations comprise envelopes which provide representation of the sequence (genetic) and antigenic diversity of the HIV-1 envelope variants which lead to the induction and maturation of the CH103 and CH235 antibody lineages. In certain embodiments the selections of envelopes comprise envelopes which show differential binding to an antibody or antibodies from CH103 and CH235 lineages (FIGS. 14-16, FIGS. 17-24, FIG. 59, FIGS. 80-82). Non-limiting embodiments of various selections of immunogens are described in Example 3 and Examples 10-13. In certain embodiments, these compositions are used in immunization methods as a prime and/or boost. The immunogens could be administered as nucleic acids, polypeptides and/or combination.

In certain embodiments the selections of envelopes comprise envelopes which show differential binding to an antibody or antibodies from CH103 and CH235 lineages (FIGS. 14-16, FIGS. 17-24, FIG. 59, FIGS. 80-82). In certain aspects, the invention provides a kit comprising a combination/selection of immunogens of Example 3, Examples 10-13. In some embodiments the selection of immunogens is selection F, selection G, or selection H. In some embodiments the kit comprises instructions on how to carry out the immunization regimen. In some embodiments the kit comprises instructions on administration of the selection of immunogens as a prime or boost as part of a prime/boost immunization regimen. In certain aspects, the invention provides a kit comprising any one of the immunogens of Example 3 and Example 10, or in selection F, G, or H and instructions on how to carry out an immunization regimen with the immunogen of the kit, including which immunogen(s) are a prime immunization and which immunogen(s) comprise a boost immunization. In some embodiments the kit comprises instructions on administration of the immunogen as a prime or as a boost as part of a prime/boost immunization regimen. In some embodiments the immunogen could be administered sequentially or additively.

In certain aspects, the invention provides a kit comprising Env M5, M11, 20.14, 30.20, 30.12, 30.21 30.23, 30.25, 30.28, 53.25, 53.29, 53.31, 78.15, 100.B6 and/or 136.B18. In some embodiments the kit comprises instructions on how to carry out the immunization regimen, including which immunogen(s) are a prime immunization and which immunogen(s) comprise a boost immunization. In some embodiments the kit comprises instructions on administration of the immunogen as a prime or as a boost as part of a prime/boost immunization regimen.

In some embodiments, the kit comprises Env M5, M11, w20.14, w30.20 and/or w136.B18 and instructions on administration of the immunogen as a prime or boost as part of a prime/boost immunization regimen with M5, M11, w20.14, w30.20 and/or w136.B18, including which immunogen(s) are a prime immunization and which immunogen(s) comprise a boost immunization In some embodiments, the kit comprises Env M5, w30.25, w53.25 and/or w53.29 and instructions on administration of the immunogen as a prime or boost as part of a prime/boost immunization regimen with M5, w30.25, w53.25 and/or w53.29, including which immunogen(s) are a prime immunization and which immunogen(s) comprise a boost immunization.

In one aspect the invention provides selections of envelopes from individual CH505, which selections can be used in compositions for immunizations to induce lineages of broad neutralizing antibodies. In certain embodiments, there is some variance in the immunization regimen; in some embodiments, the selection of HIV-1 envelopes may be grouped in various combinations of primes and boosts, either as nucleic acids, proteins, or combinations thereof. In certain embodiments the compositions are pharmaceutical compositions which are immunogenic. In certain embodiments, the compositions comprise amounts of envelopes which are therapeutic and/or immunogenic.

In one aspect the invention provides a composition for a prime boost immunization regimen comprising any one of the envelopes described herein, or any combination thereof wherein the envelope is a prime or boost immunogen. In certain embodiments the composition for a prime boost immunization regimen comprises one or more envelopes from FIGS. 14-16, FIGS. 17-24, FIG. 59, FIGS. 80-82, Example 3, or from immunogen selection F, selection G, or selection H. In some embodiments, the composition for a prime boost immunization regimen comprises one or more envelopes M5, M11, 20.14, 30.20, 30.12, 30.21 30.23, 30.25, 30.28, 53.25, 53.29, 53.31, 78.15, 100.B6 and/or 136.B18.

In one aspect the invention provides a composition comprising any one of the envelopes described herein, or any combination thereof—for example but not limited to selections in Examples and FIGS. 14, 15, 16, 17-24. In other aspects, the invention provides use of these selections of envelopes in methods to induce an immune response. In non-limiting embodiments the envelope selections induce antibodies in the CH235 lineage, for example antibody CH557, (described in Example 8).

In some embodiments, CH505 M11 Env is administered first as a prime, followed by a mixture of a next group of Envs. In some embodiments, grouping of the envelopes is based on their binding affinity for the antibodies expected to be induced. In some embodiments, grouping of the envelopes is based on chronological evolution of envelope viruses that occurs in the setting of bnAb generation in vivo in HIV-1 infection. In some embodiments Loop D mutants could be included in either prime and/or boost. In some embodiments, the composition comprises an adjuvant. In some embodiments, the composition and methods comprise use of agents for transient modulation of the host immune response.

In one aspect the invention provides a composition comprising nucleic acids encoding HIV-1 envelope which is a loop D mutant, e.g. M11 or any other suitable D loop mutant or combination thereof, e.g. M11 and M5.

In another aspect the invention provides a method of inducing an immune response in a subject comprising administering a composition comprising HIV-1 envelope M11 and/or M5 as a prime in an amount sufficient to induce an immune response, wherein the envelope is administered as a polypeptide or a nucleic acid encoding the same. A method of inducing an immune response in a subject comprising administering a composition comprising HIV-1 envelope M11 and M5 as a prime in an amount sufficient to induce an immune response, wherein the envelope is administered as a polypeptide or a nucleic acid encoding the same.

In certain embodiments the methods comprise administering any of the selection listed in Example 3. In certain embodiments the methods comprise administering Envs M5, M11, 20.14, 30.28, 30.23, and/or 136.B18. In certain embodiments the methods comprise administering Envs M5, M11, 20.14, 30.20, 30.23, and/or 136.B18. In certain embodiments the methods comprise administering Envs M5, M11, 20.14, 30.20, 30.12, and/or 136.B18. In certain embodiments the methods comprise administering envelopes M5, 30.25, 53.25, and/or 53.29.

In certain embodiments the methods further comprise administering a composition comprising any one of HIV-1 envelope M11, w020.14, w030.28, w078.15, w053.31 or any combination thereof as a boost, wherein the envelope is administered as a polypeptide or a nucleic acid encoding the same.

In certain embodiments the methods comprise administering a composition comprising any one of HIV-1 envelope M11, M5, w020.14, w030.28, w078.15, w053.31 or any combination thereof as a boost, wherein the envelope is administered as a polypeptide or a nucleic acid encoding the same.

In another aspect the invention provides a method of inducing an immune response in a subject comprising administering a composition comprising HIV-1 envelope M11, M5, w020.14, w030.28, w078.15, w053.16, w030.21, w078.33, w100.B6, w053.31 or any combination thereof as a prime and/or boost in an amount sufficient to induce an immune response, wherein the envelope is administered as a polypeptide or a nucleic acid encoding the same.

In certain embodiments, the compositions contemplate nucleic acid, as DNA and/or RNA, or proteins immunogens either alone or in any combination. In certain embodiments, the methods contemplate genetic, as DNA and/or RNA, immunization either alone or in combination with envelope protein(s).

In certain embodiments the nucleic acid encoding an envelope is operably linked to a promoter inserted an expression vector. In certain aspects the compositions comprise a suitable carrier. In certain aspects the compositions comprise a suitable adjuvant.

In certain embodiments the induced immune response includes induction of antibodies, including but not limited to autologous and/or cross-reactive (broadly) neutralizing antibodies against HIV-1 envelope. Various assays that analyze whether an immunogenic composition induces an immune response, and the type of antibodies induced are known in the art and are also described herein.

In certain aspects the invention provides an expression vector comprising any of the nucleic acid sequences of the invention, wherein the nucleic acid is operably linked to a promoter. In certain aspects the invention provides an expression vector comprising a nucleic acid sequence encoding any of the polypeptides of the invention, wherein the nucleic acid is operably linked to a promoter. In certain embodiments, the nucleic acids are codon optimized for expression in a mammalian cell, in vivo or in vitro. In certain aspects the invention provides nucleic acids comprising any one of the nucleic acid sequences of invention. In certain aspects the invention provides nucleic acids consisting essentially of any one of the nucleic acid sequences of invention. In certain aspects the invention provides nucleic acids consisting of any one of the nucleic acid sequences of invention. In certain embodiments the nucleic acid of the invention, is operably linked to a promoter and is inserted in an expression vector. In certain aspects the invention provides an immunogenic composition comprising the expression vector.

In certain aspects the invention provides a composition comprising at least one of the nucleic acid sequences of the invention. In certain aspects the invention provides a composition comprising any one of the nucleic acid sequences of invention. In certain aspects the invention provides a composition comprising at least one nucleic acid sequence encoding any one of the polypeptides of the invention.

In certain aspects the invention provides a composition comprising at least one nucleic acid encoding HIV-1 envelope M11, M5, w020.14, w030.28, w078.15, w053.16, w030.21, w078.33, w100.B6, w053.31 or any combination thereof. Non-limiting examples of combinations are shown in Example 2.

In certain embodiments, the compositions and methods employ an HIV-1 envelope as polypeptide instead of a nucleic acid sequence encoding the HIV-1 envelope. In certain embodiments, the compositions and methods employ an HIV-1 envelope as polypeptide, a nucleic acid sequence encoding the HIV-1 envelope, or a combination thereof.

The envelope used in the compositions and methods of the invention can be a gp160, gp150, gp145, gp140, gp120, gp41, N-terminal deletion variants as described herein, cleavage resistant variants as described herein, or codon optimized sequences thereof. In certain embodiments the composition comprises envelopes as trimers. In certain embodiments, envelope proteins are multimerized, for example trimers are attached to a particle such that multiple copies of the trimer are attached and the multimerized envelope is prepared and formulated for immunization in a human. In certain embodiments, the compositions comprise envelopes, including but not limited to trimers as particulate, high-density array on liposomes or other particles, for example but not limited to nanoparticles. In some embodiments, the trimers are in a well ordered, near native like or closed conformation. In some embodiments the trimer compositions comprise a homogenous mix of native like trimers. In some embodiments the trimer compositions comprise at least 85%, 90%, 95% native like trimers.

The polypeptide contemplated by the invention can be a polypeptide comprising any one of the polypeptides described herein. The polypeptide contemplated by the invention can be a polypeptide consisting essentially of any one of the polypeptides described herein. The polypeptide contemplated by the invention can be a polypeptide consisting of any one of the polypeptides described herein. In certain embodiments, the polypeptide is recombinantly produced. In certain embodiments, the polypeptides and nucleic acids of the invention are suitable for use as an immunogen, for example to be administered in a human subject.

In certain embodiments the envelope is any of the forms of HIV-1 envelope. In certain embodiments the envelope is gp120, gp140, gp145 (i.e. with a transmembrane), gp150. In certain embodiments, gp140 designed to form a stable trimer (See Tables 1A-B, FIGS. 22-24, FIG. 59, FIGS. 80-82, Example 9 for non-limiting examples of sequences of stable trimer designs). In certain embodiments envelope protomers form a trimer which is not a SOSIP timer. In certain embodiment the trimer is a SOSIP based trimer wherein each protomer comprises additional modifications. In certain embodiments, envelope trimers are recombinantly produced. In certain embodiments, envelope trimers are purified from cellular recombinant fractions by antibody binding and reconstituted in lipid comprising formulations. See for example WO2015/127108 titled "Trimeric HIV-1 envelopes and uses thereof" which content is herein incorporated by reference in its entirety. In certain embodiments the envelopes of the invention are engineered and comprise non-naturally occurring modifications.

In certain embodiments, the envelope is in a liposome. In certain embodiments the envelope comprises a transmembrane domain with a cytoplasmic tail embedded in a liposome. In certain embodiments, the nucleic acid comprises a nucleic acid sequence which encodes a gp120, gp140, gp145, gp150, gp160.

In certain embodiments, where the nucleic acids are operably linked to a promoter and inserted in a vector, the vectors is any suitable vector. Non-limiting examples, include, VSV, replicating rAdenovirus type 4, MVA, Chimp adenovirus vectors, pox vectors, and the like. In certain embodiments, the nucleic acids are administered in Nano-Taxi block polymer nanospheres. In certain embodiments, the composition and methods comprise an adjuvant. Non-limiting examples include, AS01 B, AS01 E, gla/SE, alum, Poly I poly C (poly IC), polyIC/long chain (LC) TLR agonists, TLR7/8 and 9 agonists, or a combination of TLR7/8 and TLR9 agonists (see Moody et al. (2014) J. Virol. March 2014 vol. 88 no. 6 3329-3339), or any other adjuvant. Non-limiting examples of TLR7/8 agonist include TLR7/8 ligands, Gardiquimod, Imiquimod and R848 (resiquimod). A non-limiting embodiment of a combination of TLR7/8 and TLR9 agonist comprises R848 and oCpG in STS (see Moody et al. (2014) J. Virol. March 2014 vol. 88 no. 6 3329-3339).

In certain aspects the invention provides a cell comprising a nucleic acid encoding any one of the envelopes of the invention suitable for recombinant expression. In certain aspects, the invention provides a clonally derived population of cells encoding any one of the envelopes of the invention suitable for recombinant expression. In certain aspects, the invention provides a sable pool of cells encoding any one of the envelopes of the invention suitable for recombinant expression.

In certain aspects, the invention provides a recombinant HIV-1 envelope polypeptide from Tables 1A-B, wherein the polypeptide is a non-naturally occurring protomer designed to form an envelope trimer. The invention also provides nucleic acids encoding these recombinant polypeptides. Non-limiting examples of amino acids and nucleic acid of such protomers are shown in FIGS. 22-24, FIG. 59, FIGS. 80-82.

In certain aspects the invention provides a recombinant trimer comprising three identical protomers of an envelope from Tables 1A-B. In certain aspects the invention provides an immunogenic composition comprising the recombinant trimer and a carrier, wherein the trimer comprises three identical protomers of an HIV-1 envelope listed in Tables 1A-B. In certain aspects the invention provides an immunogenic composition comprising nucleic acid encoding these recombinant HIV-1 envelopes and a carrier.

In certain aspects the invention provides a selection of HIV-1 envelopes or any suitable form of a nucleic acid encoding HIV-1 envelope for use in an immunization regimen, wherein the selections of envelopes comprises envelopes M5, M11, w20.14, w30.20, w30.12, and w136.B18 (Selection F, e.g. listed in FIG. 18A) or any combination thereof, envelopes M5, w30.25, w53.25, and w53.29 (Selection G, e.g. FIG. 20) or any combination thereof, envelopes M5, w30.20, w20.14, and w30.12 (Selection H, e.g. FIG. 21) or any combination thereof. In certain aspects the invention provides a selection of HIV-1 envelopes for immunization wherein the HIV-1 envelope is a loop D mutant envelope M5 and/or M11. In certain embodiments the prime is M5.

In certain aspects the invention provides a selection of nucleic acids encoding HIV-1 envelopes for immunization wherein the nucleic acid encodes a gp120 envelope, gp120D8 envelope, a gp140 envelope (gp140C, gp140CF, gp140CFI) as soluble or stabilized protomer of a SOSIP trimer, a gp145 envelope, a gp150 envelope, or a transmembrane bound envelope.

In certain aspects the invention provides a selection of HIV-1 envelopes for immunization wherein the HIV-1 envelope is a gp120 envelope or a gp120D8 variant. In certain embodiments a composition for immunization comprises protomers that form stabilized trimers, e.g. but not limited to SOSIP.III trimers.

In certain embodiments, the compositions for use in immunization further comprise an adjuvant.

In certain embodiments, wherein the compositions comprise a nucleic acid, the nucleic acid is operably linked to a promoter, and could be inserted in an expression vector.

In certain aspects, the invention provides a kit comprising a combination/selection of immunogens of from Tables 1A-B, wherein the polypeptide is a non-naturally occurring protomer designed to form an envelope trimer. In certain aspects, the invention provides a kit comprising a combination/selection of immunogens of from FIGS. 22-24. In some embodiments the kit comprises instructions on how to carry out the immunization regimen, including which immunogen(s) are a prime immunization and which immunogen(s) comprise a boost immunization. In some embodiments the kit comprises instructions on administration of the selection of immunogens as a prime or boost as part of a prime/boost immunization regimen. In certain aspects, the invention provides a kit comprising any one of the immunogens from Tables 1A-B, wherein the polypeptide is a non-naturally occurring protomer designed to form an envelope trimer and instructions on how to carry out an immunization regimen with the immunogen of the kit. In some embodiments the kit comprises instructions on administration of the immunogen as a prime or as a boost as part of a prime/boost immunization regimen. In some embodiments the immunogen could be administered sequentially or additively. In certain aspects, the invention provides a kit comprising a combination/selection of immunogens of from FIGS. 22-24.

In one aspect the invention provides a composition for a prime boost immunization regimen comprising one or more envelopes from Tables 1A-B, wherein the polypeptide is a non-naturally occurring protomer designed to form an envelope trimer, wherein the envelope is a prime or boost immunogen. In one aspect the invention provides a composition for a prime boost immunization regimen comprising one or more envelopes from FIGS. 22-24 wherein the envelope is a prime or boost immunogen.

In certain aspects the invention provides methods of inducing an immune response in a subject comprising administering a composition comprising any suitable form of a nucleic acid(s) encoding an HIV-1 envelope(s) in an amount sufficient to induce an immune response from one or more of the following groups: (a) the selection of envelopes M5, M11, w20.14, w30.20, w30.12, and w136.B18 (Selection F, e.g. listed in FIG. 18A) or any combination thereof; (b) envelopes M5, w30.25, w53.25, and w53.29 (Selection G, e.g. FIG. 20) or any combination thereof; (c) envelopes M5, w30.20, w20.14, and w30.12 (Selection H, e.g. FIG. 21) or any combination thereof and wherein the administration step can alternatively, or in addition, comprise administering an HIV-1 polypeptide(s) in an amount sufficient to induce an immune response from one or more of the following groups: (a) envelopes M5, M11, w20.14, w30.20, w30.12, and w136.B18 (Selection F, e.g. listed in FIG. 18A) or any combination thereof; (b) envelopes M5, w30.25, w53.25, and w53.29 (Selection G, e.g. FIG. 20) or any combination thereof; (c) envelopes M5, w30.20, w20.14, and w30.12 (Selection H, e.g. FIG. 21) or any combination thereof. In certain embodiments, the composition comprises M5 or a nucleic acid encoding M5 that is administered as a prime immunogen. In certain embodiments, the methods further comprise administering M11 or a nucleic acid encoding M11. In certain embodiments, the methods further comprise administering HIV-1 envelope w20.14 or a nucleic acid encoding HIV-1 envelope w20.14, followed by administering HIV-1 envelope w30.20 or a nucleic acid encoding HIV-1 envelope w30.20, and followed by administering HIV-1 envelope w30.12 or a nucleic acid encoding HIV-1 envelope w30.12. In certain embodiments, the methods further comprise administering HIV-1 envelope w136.B18 or a nucleic acid encoding HIV-1 envelope w136.B18.

In certain embodiments, the methods further comprise administering HIV-1 envelope w30.25 or a nucleic acid encoding HIV-1 envelope w30.25, HIV-1 envelope w53.25 or a nucleic acid encoding HIV-1 envelope w53.25, HIV-1 envelope w53.29 or a nucleic acid encoding HIV-1 envelope w53.29.

In certain embodiments, the nucleic acid encodes a gp120 envelope, gp120D8 envelope, a gp140 envelope (gp140C, gp140CF, gp140CFI) as soluble or stabilized protomer of a SOSIP trimer, a gp145 envelope, a gp150 envelope, or a transmembrane bound envelope. In certain embodiments, the polypeptide is gp120 envelope, gp120D8 envelope, a gp140 envelope (gp140C, gp140CF, gp140CFI) as soluble or stabilized protomer of a SOSIP trimer, a gp145 envelope, a gp150 envelope, or a transmembrane bound envelope.

In certain aspects, the invention provides a method of inducing an immune response in a subject comprising administering a composition comprising envelope CH505 T/F, followed by envelope w53.16, followed by envelope w78.33 and followed by envelope w100.B6, wherein each composition comprises the envelope as a trimer. In certain embodiments of the method the selection of immunogens is administered as nucleic acids.

In certain embodiments, the methods comprise administering an adjuvant. In certain embodiments, the methods comprise administering an agent which modulates host immune tolerance. In certain embodiments, the administered polypeptide is multimerized in a liposome or nanoparticle. In certain embodiments, the methods comprise administering one or more additional HIV-1 immunogens to induce a T cell response. Non-limiting examples include gag, nef, pol, etc.

In certain aspects, the invention provides a recombinant HIV-1 Env ectodomain trimer, comprising three gp120-gp41 protomers comprising a gp120 polypeptide and a gp41 ectodomain, wherein each protomer is the same and each protomer comprises portions from envelope BG505 HIV-1 strain and gp120 polypeptide portions from a CH505 HIV-1 strain and stabilizing mutations A316W and E64K, (see e.g. FIG. 23). In certain embodiments, the trimer is stabilized in a prefusion mature closed conformation, and wherein the trimer does not comprise non-natural disulfide bond between cysteine substitutions at positions 201 and 433 of the HXB2 reference sequence. Non-limited examples of envelopes contemplated as trimers are listed in Tables 1A-B. In some embodiments, the amino acid sequence of one monomer comprised in the trimer is shown in FIG. 22-24, FIG. 59, FIGS. 80-82. In some embodiments, the trimer is immunogenic. In some embodiments the trimer binds to any one of the antibodies PGT145, PGT151, CH103UCA, CH103, VRC01, PGT128, or any combination thereof. In some embodiments the trimer does not bind to antibody 19B and/or 17B.

In certain aspects, the invention provides a pharmaceutical composition comprising any one of the recombinant trimers of the invention. In certain embodiments the compositions comprising trimers are immunogenic. The percent trimer in such immunogenic compositions could vary. In some embodiments the composition comprises 70%, 71%, 72%, 73%, 74%, 75%, 76%, 77%, 78%, 79%, 80%, 81%, 82%, 83%, 84%, 85%, 86%, 87%, 89%, 90%, 91%, 92%, 93%, 94%, 95%, 96%, 97%, 98%, 99% stabilized trimer.

In certain aspects the invention provides any suitable form of a nucleic acid encoding a HIV-1 envelope from the selections of envelopes listed in FIG. 14A (envelopes M5, M11, 20.14, 30.28, 30.23. and 136.B18), FIG. 15A (envelopes M5, M11, 20.14, 30.20, 30.23. and 136.B18), FIG. 16A (envelopes M5, M11, 20.14, 30.20, 30.12. and 136.B18), FIG. 18A (envelopes M5, M11, 20.14, 30.20, 30.12, and 136.B18), FIG. 20 (M5, 30.25; 53.25; and 53.29), FIG. 21 (M5, w30.20, w20.14, w30.12), or any combination thereof. In certain embodiments the envelopes bind preferentially to an antibody or antibodies from CH103 lineage. In certain embodiments the envelopes bind preferentially to an antibody or antibodies from CH235 lineage. In certain aspects the invention provides a polypeptide from the selections of envelopes listed in FIG. 14A (envelopes M5, M11, 20.14, 30.28, 30.23. and 136.B18), FIG. 15A (envelopes M5, M11, 20.14, 30.20, 30.23. and 136.B18), FIG. 16A (envelopes M5, M11, 20.14, 30.20, 30.12. and 136.B18), FIG. 18A (envelopes M5, M11, 20.14, 30.20, 30.12, and 136.B18), FIG. 20 (M5, 30.25; 53.25; and 53.29), FIG. 21 (M5, w30.20, w20.14, w30.12), or any combination thereof. In certain aspects the invention provides a composition comprising any suitable form of the nucleic acids of the invention. In certain aspects the invention provides a composition comprising any suitable polypeptide, wherein the polypeptide is engineered and recombinantly produced.

BRIEF DESCRIPTION OF THE DRAWINGS

To conform to the requirements for PCT patent applications, many of the figures presented herein are black and white representations of images originally created in color.

FIG. 1 shows sequences of six envelopes (SEQ ID NOS 19-67, respectively in order of appearance): CH505.M5gp145, CH505.M11gp145, CH505w020.14gp145, CH505w030.28gp145, CH505w078.15gp145, CH505w053.31gp145, also as gp120D8 and gp160 amino acid and nucleic acid sequences. SEQ ID NOS 19-67 are included in the Sequence Listing which is submitted electronically herewith in ASCII format and is hereby incorporated by reference in its entirety and forms part of the specification.

FIG. 2A shows sequences of ten envelopes (SEQ ID NOS 68-98, respectively, in order of appearance): CH505.M5gp145, CH505.M11gp145, CH505w020.14gp145, CH505w030.28gp145, CH505w078.15gp145, CH505w53.16gp145, CH505w30.21gp145, CH505w78.33gp145, CH505w100.B6gp145, CH505w053.31gp145, amino acid and nucleic acid sequences. SEQ ID NOS 68-98 are included in the Sequence Listing which is submitted electronically herewith in ASCII format and is hereby incorporated by reference in its entirety and forms part of the specification.

FIG. 2B shows sequences of ten envelopes (SEQ ID NOS 99-124, respectively, in order of appearance): CH505.M5D8gp120, CH505.M11D8gp120, CH505w020.14D8gp120, CH505w030.28D8gp120, CH505w078.15D8gp120, CH505w053.16D8gp120, CH505w030.21D8gp120, CH505w078.33D8gp120, CH505w100.B6D8gp120, CH505w053.31D8gp120 as amino acids and nucleic acids. SEQ ID NOS 99-124 are included in the Sequence Listing which is submitted electronically herewith in ASCII format and is hereby incorporated by reference in its entirety and forms part of the specification.

FIG. 2C shows sequences of ten envelopes of FIG. 2B as gp160 amino acid and nucleic acid sequences (SEQ ID NOS 125-144, respectively, in order of appearance). SEQ ID NOS 125-144 are included in the Sequence Listing which is submitted electronically herewith in ASCII format and is hereby incorporated by reference in its entirety and forms part of the specification.

FIG. 9 shows neutralization activity of CH103 clonal lineage antibodies against autologous CH505 viruses.

FIG. 10 shows neutralization susceptibility of the CH505 loop D mutants to CH103 lineage antibodies.

FIG. 12 shows neutralization susceptibility of CH505 loop D mutants to CH235 lineage antibodies.

FIG. 13 shows neutralization activity of CH235 clonal lineage antibodies against autologous CH505 viruses.

FIGS. 16A-B show a binding log Area Under the Curve, AUC) of Sequential Envs M5, M11, 20.14, 30.20, 30.12, 136.B18 to CH103 (FIG. 16B) and CH235 (FIG. 16A-includes lineage member CH557) CD4 Binding Site Broadly Neutralizing Antibody Lineages members.

FIGS. 17A-B show amino acid and nucleic acid sequences of M5, M11, 20.14, 30.20, 30.12, 136.B18 envelopes: FIG. 17A shows sequences of gp120D8 variants (SEQ ID NOS 145-156, respectively, in order of appearance), FIG. 17B shows sequences of gp160 envelopes (SEQ ID NOS 157-168, respectively, in order of appearance). SEQ ID NOS 145-168 are included in the Sequence Listing which is submitted electronically herewith in ASCII format and is hereby incorporated by reference in its entirety and forms part of the specification.

FIGS. 19A-B show nucleic acid and amino acid sequences of M5, M11, 20.14, 30.20, 30.12, 136.B18 envelopes (SEQ ID NOS 169-194, respectively, in order of appearance). The highlighted portions indicate non-coding sequences—one stop codon at the end of each nucleotide sequences is not highlighted. SEQ ID NOS 169-194 are included in the Sequence Listing which is submitted electronically herewith in ASCII format and is hereby incorporated by reference in its entirety and forms part of the specification.

FIG. 22B shows nucleic acid sequences of various trimer designs of FIG. 23A (SEQ ID NOS 195-233, respectively, in order of appearance). SEQ ID NOS 195-233 are included in the Sequence Listing which is submitted electronically herewith in ASCII format and is hereby incorporated by reference in its entirety and forms part of the specification.

FIG. 23A shows amino acid sequences of various trimer designs (SEQ ID NOS 234-272, respectively, in order of appearance). In some embodiments the leader sequence for these proteins is MPMGSLQPLATLYLLGMLVASVLA (SEQ ID NO: 273). SEQ ID NOS 234-273 are included in the Sequence Listing which is submitted electronically herewith in ASCII format and is hereby incorporated by reference in its entirety and forms part of the specification.

FIG. 32 shows NHP 6207 neutralizes heterologous tier 2 virus representative global isolates. While autologous tier 2 neutralization is difficult to elicit, heterologous tier 2 neutralization is even more rare to observe in vaccinated primates. To determine whether tier 2 heterologous breadth was elicited in macaque 6207 plasma we tested neutralization against heterologous tier 2 viruses selected to represent the global circulating viruses. We examined neutralization of this 12 virus panel by the plasma at week 30-post 4 sequential protein boosts and week 36 post 5 sequential protein boosts. After 4 protein boosts two heterologous tier 2 viruses were neutralized. After the subsequent boost 9/12 of the viruses were neutralized. Although the titers were low this antibody response appears boostable and is currently the broadest tier 2 neutralization known to be achieved in a vaccinated primate.

FIG. 38 shows mutations and V5 length.

FIG. 43 shows comparison of neutralization ($IC_{50}$ values) of two lots of DH235UCAtkLL. Lot 48EML was not purified by SEC, and lot 170712PPF was purified by SEC (See FIGS. 41 and 42). The identity of the neutralized virus (envelope) is listed in the first column. The first column also indicates whether the virus was grown in 293T cell or in GnTI−/− cells. In this figures, and throughout other figures, CH0505TF.M5 refers to CH505M5 sequence. CH505 M5 has the CH505 T/F sequence with a N279K amino acid change.

FIG. 58B shows Additional boosting immunogens could be used to increase maturation of antibodies. Other cells may be used in place of 293T cells to produce naturally or fully glycosylated immunogens.

FIG. 59A shows amino acid and nucleic acid (FIG. 59B) sequence of VH and VL CH235 UCAs. FIG. 59A discloses SEQ ID NOS 397-400, respectively, in order of appearance. FIG. 59B discloses SEQ ID NOS 401-404, respectively, in order of appearance. FIG. 59C shows amino and FIG. 59D nucleic acid sequence of envelopes. FIG. 59C discloses SEQ ID NOS 405-412, respectively, in order of appearance. FIG. 59D discloses SEQ ID NOS 413-420, respectively, in order of appearance. FIG. 59E an alignment of CH505M5chim.6R.SOSIP.664v4.1 G458Y and CH505M5chim.6R.SOSIP.664v4.1. FIG. 59E discloses SEQ ID NOS 405 and 421, respectively, in ordrer of appearance.

FIG. 71 shows the CH103 mature bnAb engages each protomer of the CH505 TF SOSIP.III. The high affinity of the CH103 mature antibodies for these trimers provided an opportunity to study the stoichiometry of the interaction of the bnAb CH103 and its autologous Envelope. The unliganded trimer formed trimers and upon incubating it with CH103 Fab three CH103 Fabs were observed indicated by the arrows bound to each trimer. Thus the CH103 and gp140 had a 1 to 1 ratio for binding.

This approach has been employed to multiple CH505 Env sequences in order to make sequential vaccination regimens. A 4-valent vaccination regimen of SOSIP.II was made. The same 4—valent vaccine was made using the SOSIP.III design. A 6-valent vaccine can be made. Trimers to were analyzed for glycosylation and disulfide bond analysis and the Envs have the expected glycosylation and lack aberrant disulfide bonds.

Figure 74:
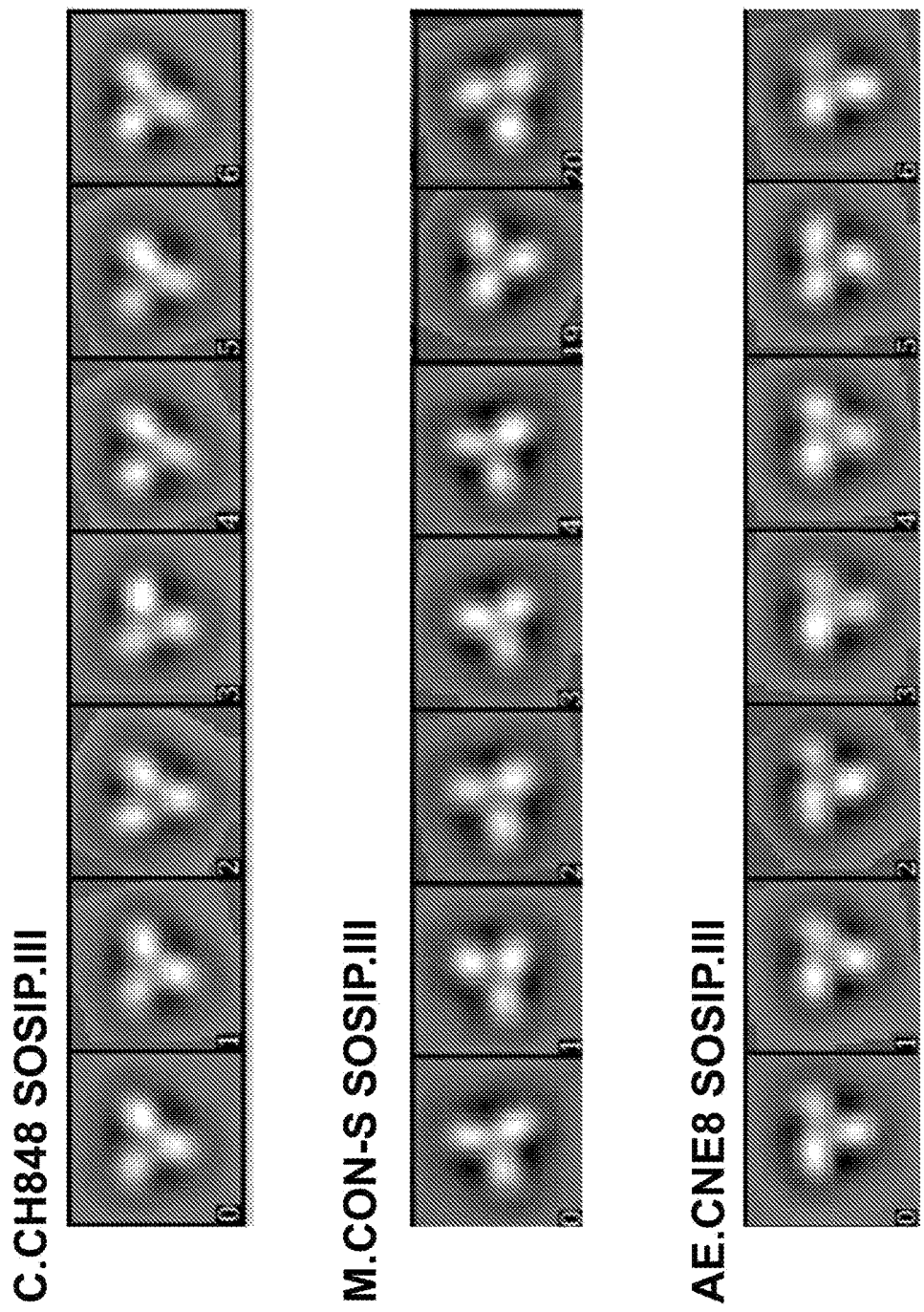

FIG. 74 shows the chimeric SOSIP.III design is applicable to diverse viruses. This design can be extrapolated to Envs that are not from the CH505 infected individual. Envs from clade C or AE or a group M consensus have all been used and form stable trimers using this design. This highlights the general applicability of this trimer design.

Figure 75:
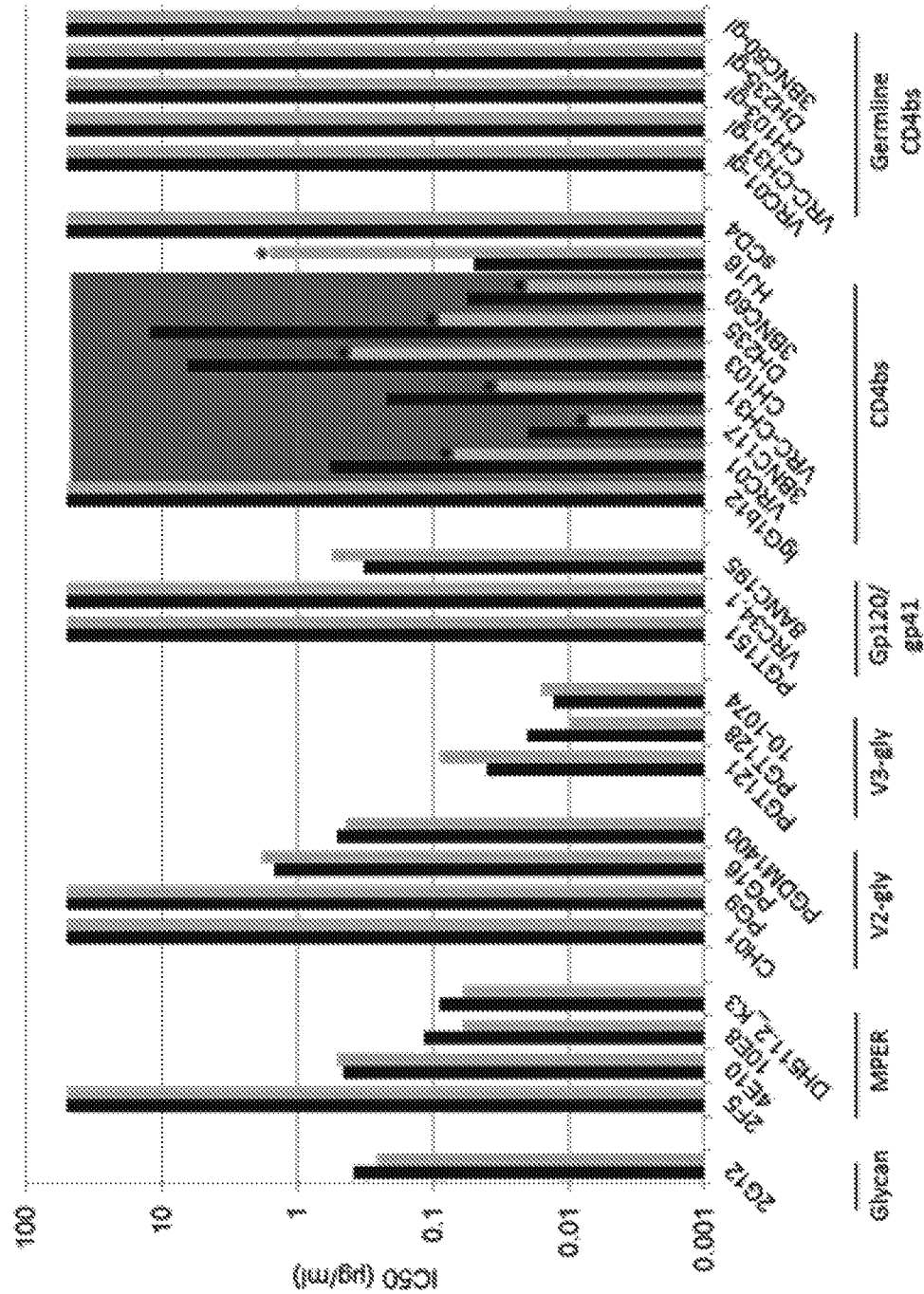

FIG. 75 shows increased potency of CD4bs bNAbs against Man5-enriched (GnTI$^-$) HIV-1.

Figure 76:
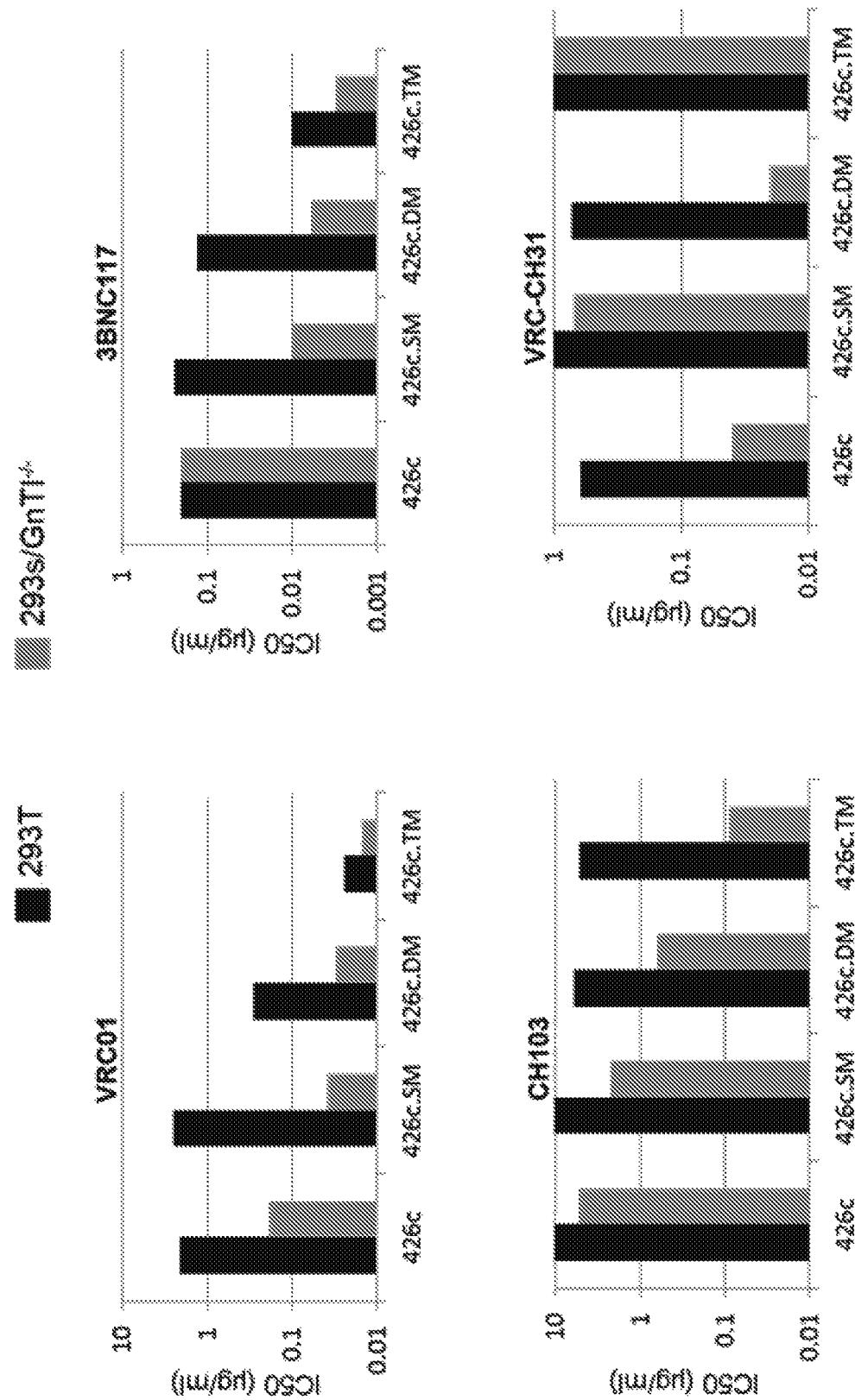

FIG. 76 shows CD4bs bNAbs that are more potent against targeted glycan-deleted, Man5-enriched viruses. SM=N276D; DM=N460D.N463D; TM=N276D.N460D. N463D.

Figure 77:
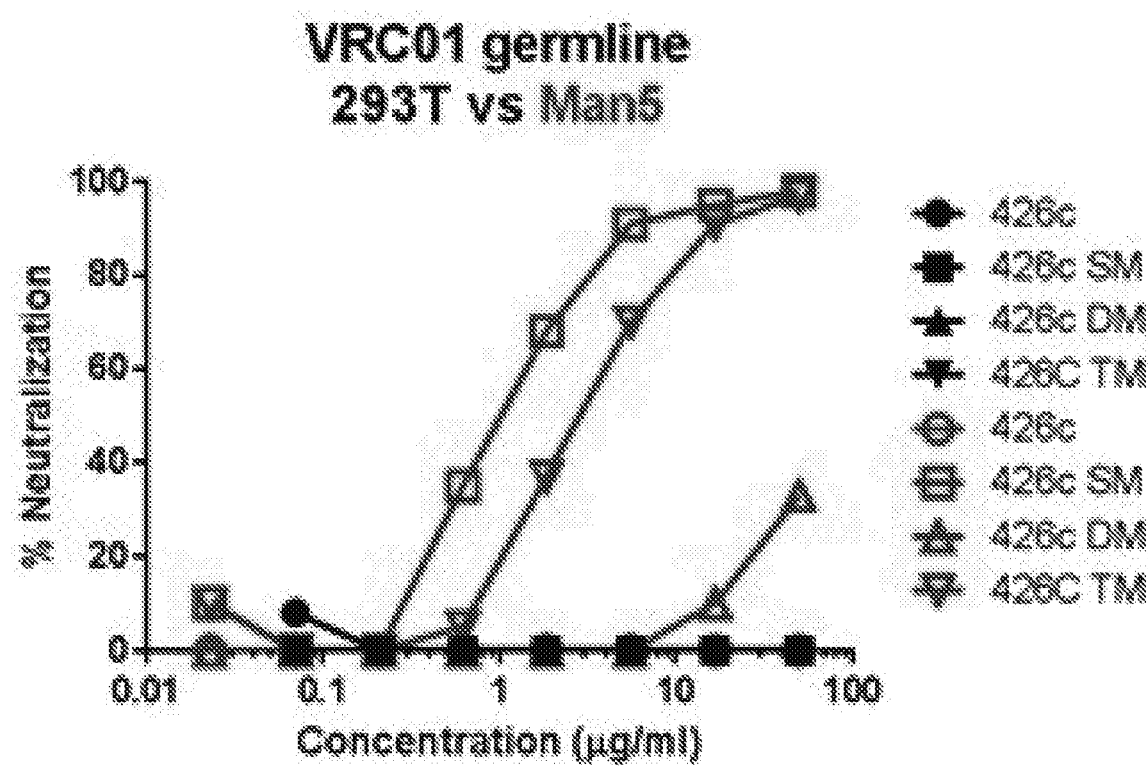
Figure 77:
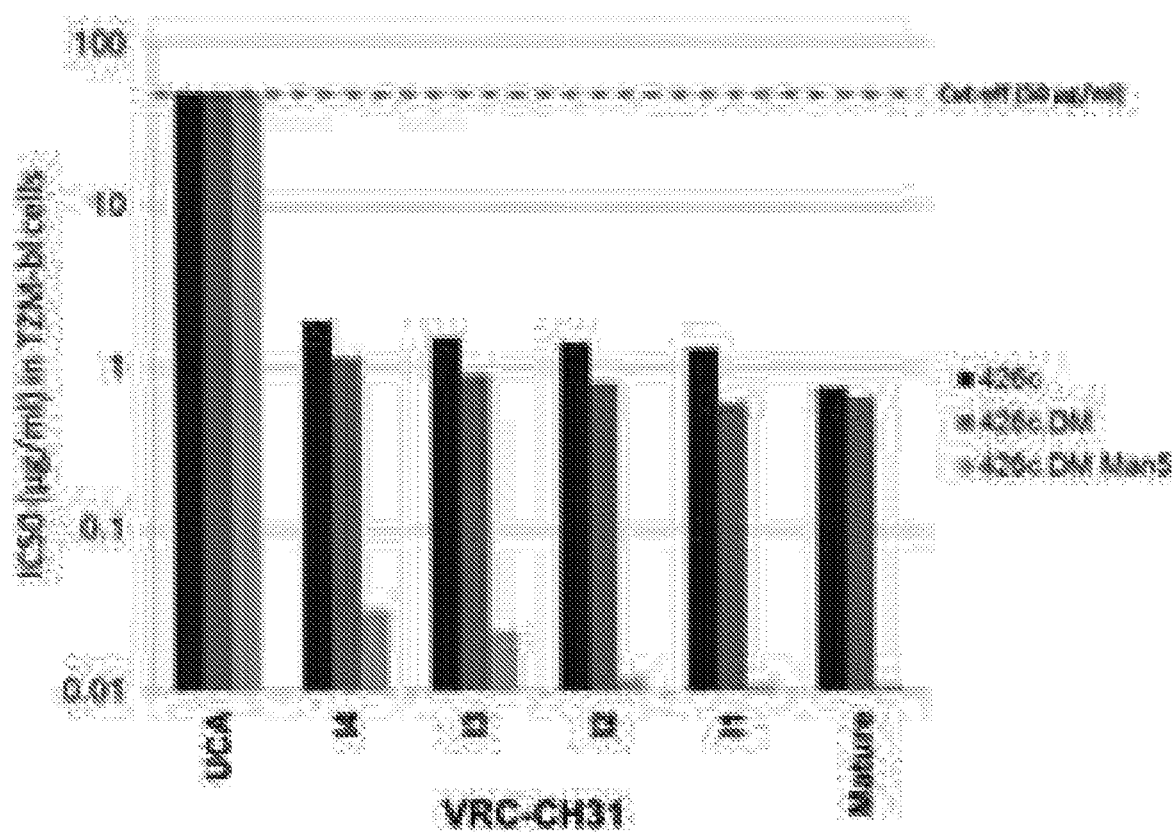

FIG. 77 shows Detection of neutralizing activity by near-germline and intermediate forms of CD4bs bNAbs. Left: Germline-reverted VRC01 assayed against 426c, 426c single mutant (SM, N276D), 426c double mutant (DM, N460D/N463D) and 426c triple mutant (TM, N276D/N460D/N463D) produced in either 293T cells or 293s/GnTI−/− cells. The germline-reverted VRC01 contains mature CDRH3 and J regions whose germlines cannot be inferred with existing sequence information. Right: Germline-reverted (UCA, unmutated common ancestor), four late intermediates (I4 is least mature, I1 is most mature) and mature VRC-CH31 assayed against 426c and 426c.DM produced in 293T cells, and against 426c.DM produced in 293s/GnTI−/− cells (Man5-enriched). Man5-enriched versions of 426c.SM and 426c.TM were not assayed because they lack a glycan at position 276 that this antibody requires for optimal neutralization.

Figure 78A:
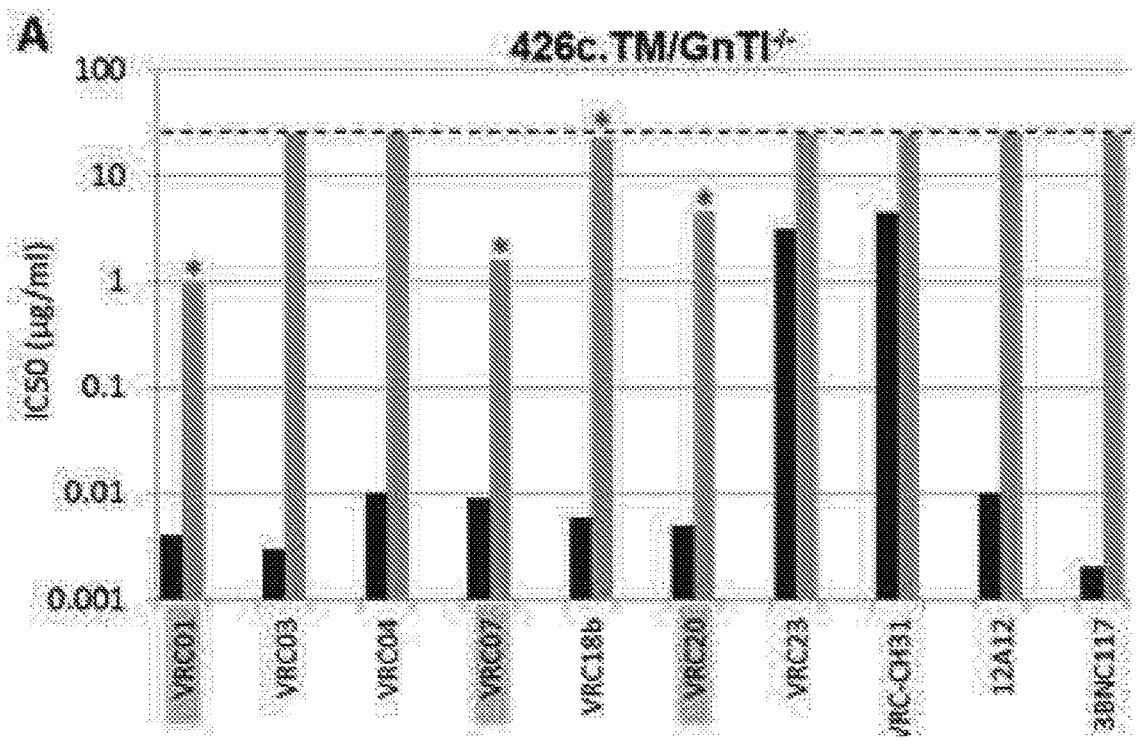
Figure 78B:
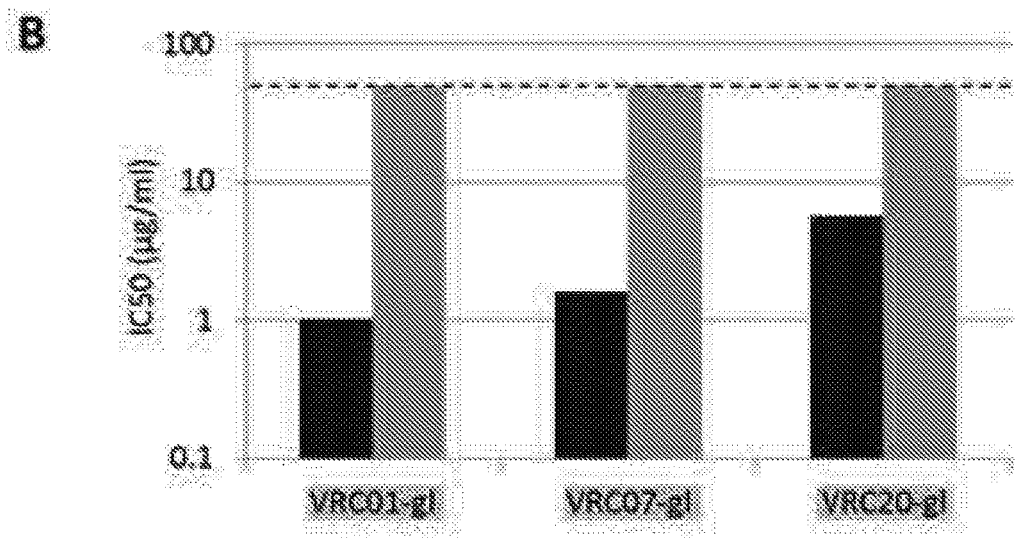

FIG. 78A-78B shows Detection and mapping of near germline-reverted variants of VRC01-class bNAbs in the context of targeted glycan-deleted GnTI−/− virus. A. Neutralizing activity of the mature (black bars) and near-germline forms (grey bars) of the indicated bNAbs. Positive neutralization by near germline forms of bNAbs are indicated by an asterisk. B. Neutralizing activity of near germline forms of VRC01 class bNAbs against 426c.TM/GnTI−/− (black bars) and 426c.TM.D279K/GnTI−/− (grey bars). Horizontal dashed lines indicate the highest concentrations of antibodies tested (25 µg/ml in A, 50 µg/ml in B).

Figure 79A:
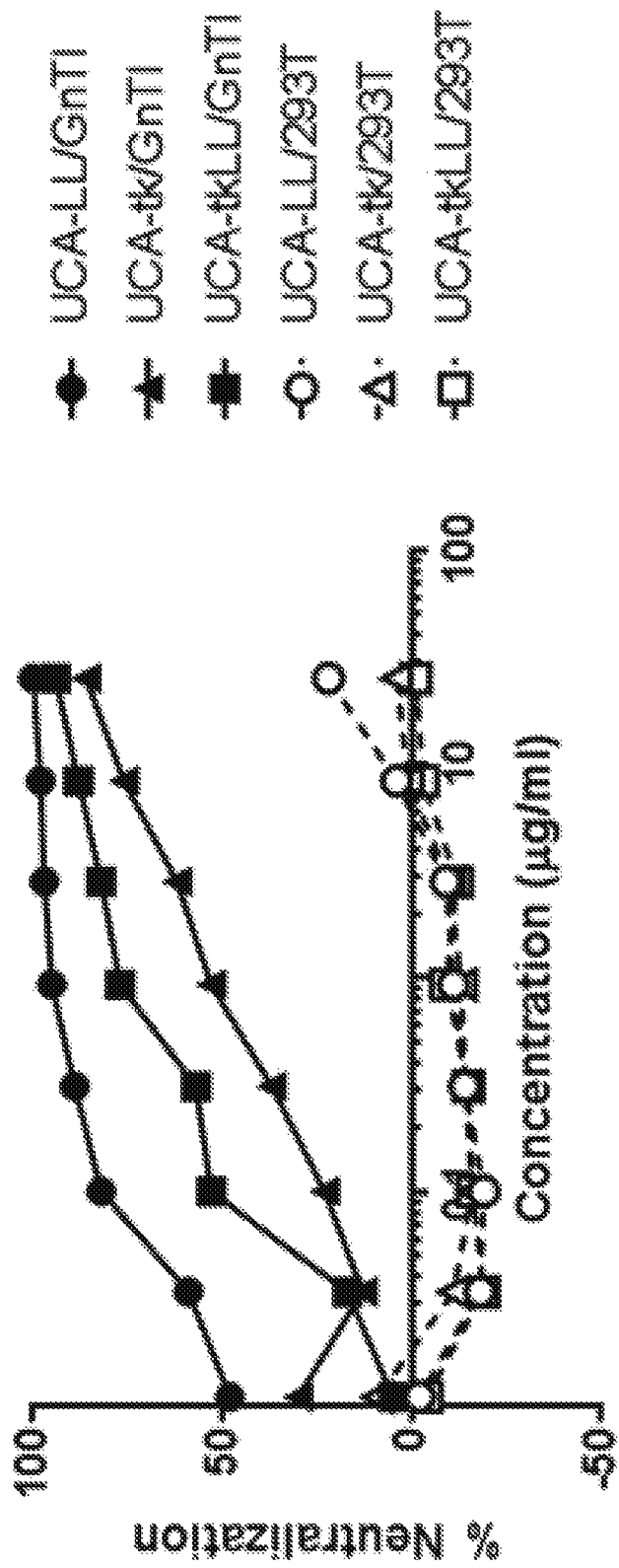
Figure 79B:
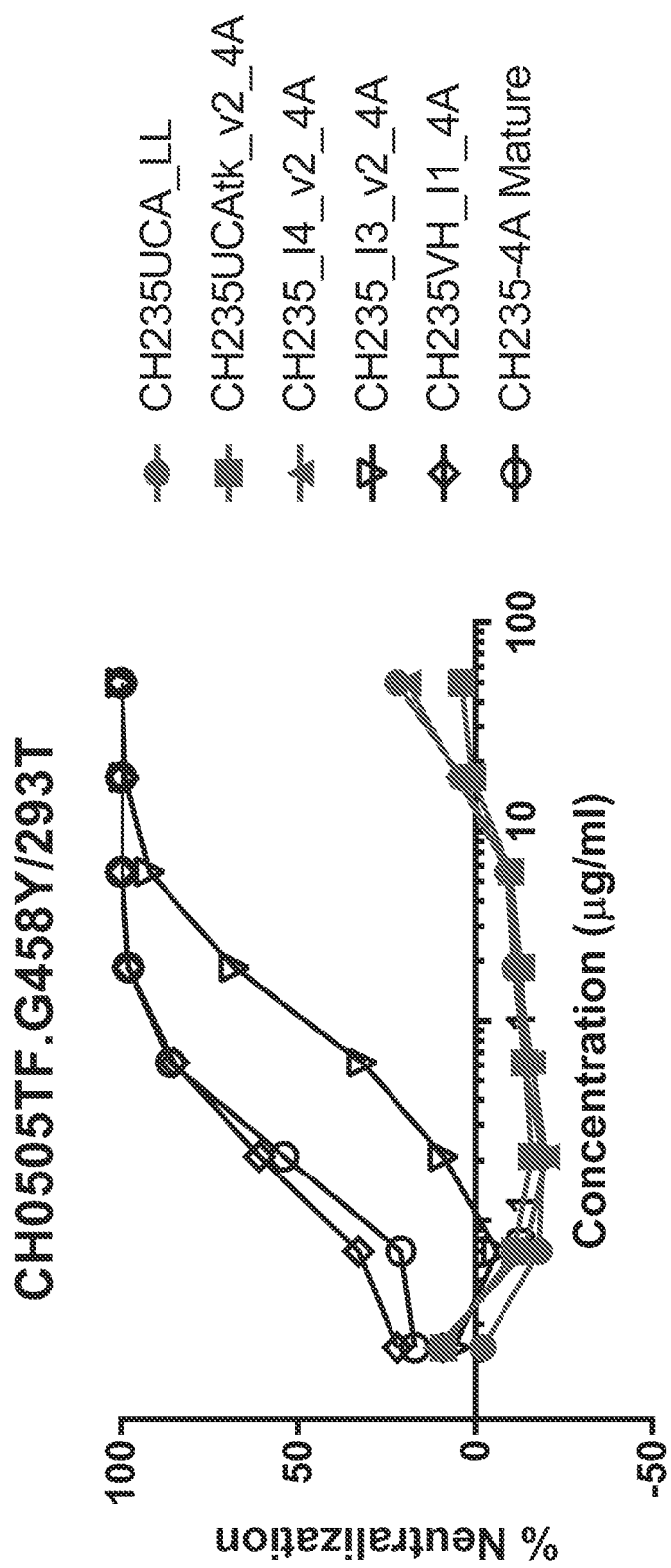
Figure 79C:
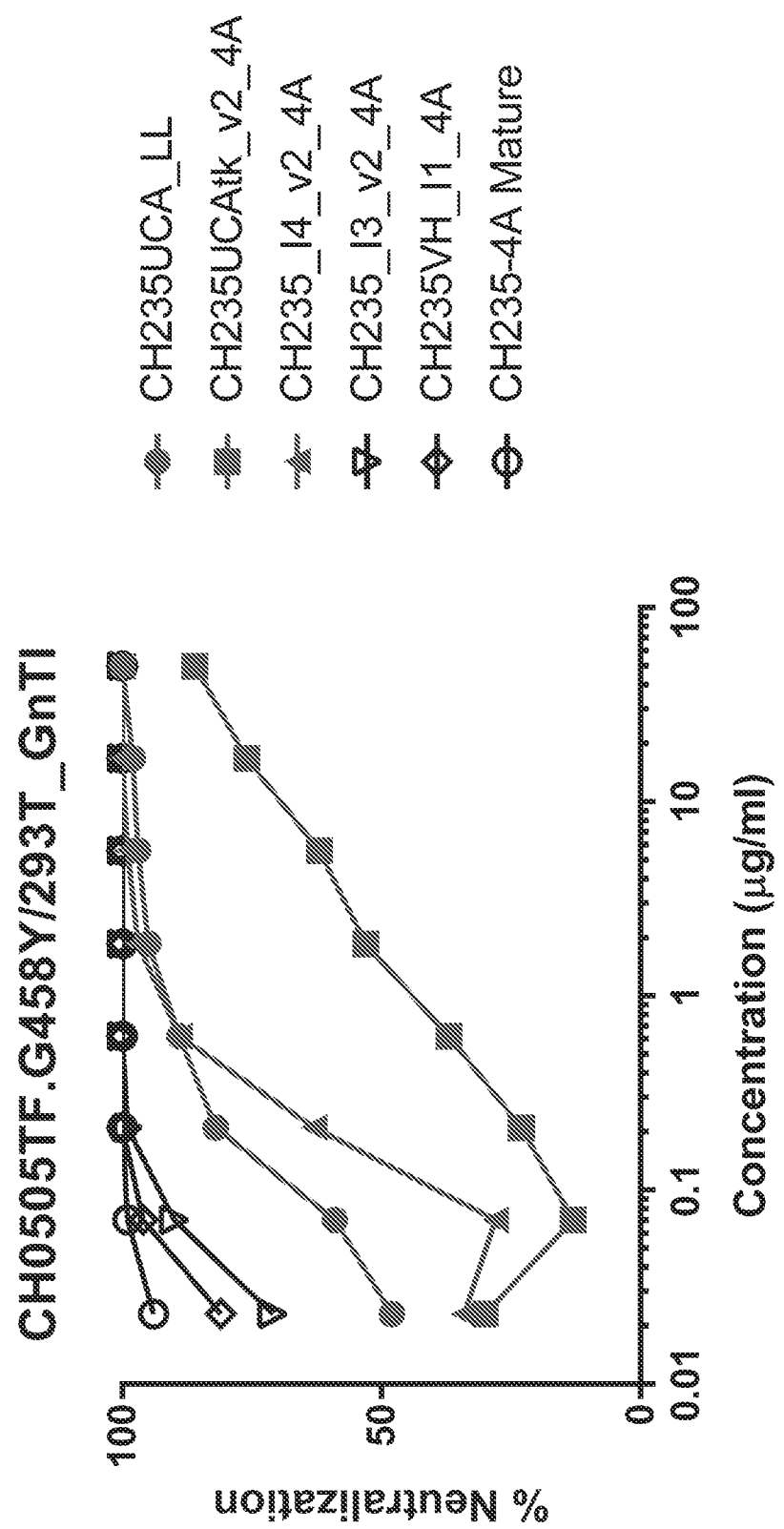

FIG. 79A-79C shows Neutralization of CH0505.G458Y by three UCAs of CH235 is seen when the virus is produced in 293s.GnTI−/− cells but not when produced in 293T cells. Data are summarized in Example 10 Table 3.

Figure 80A:
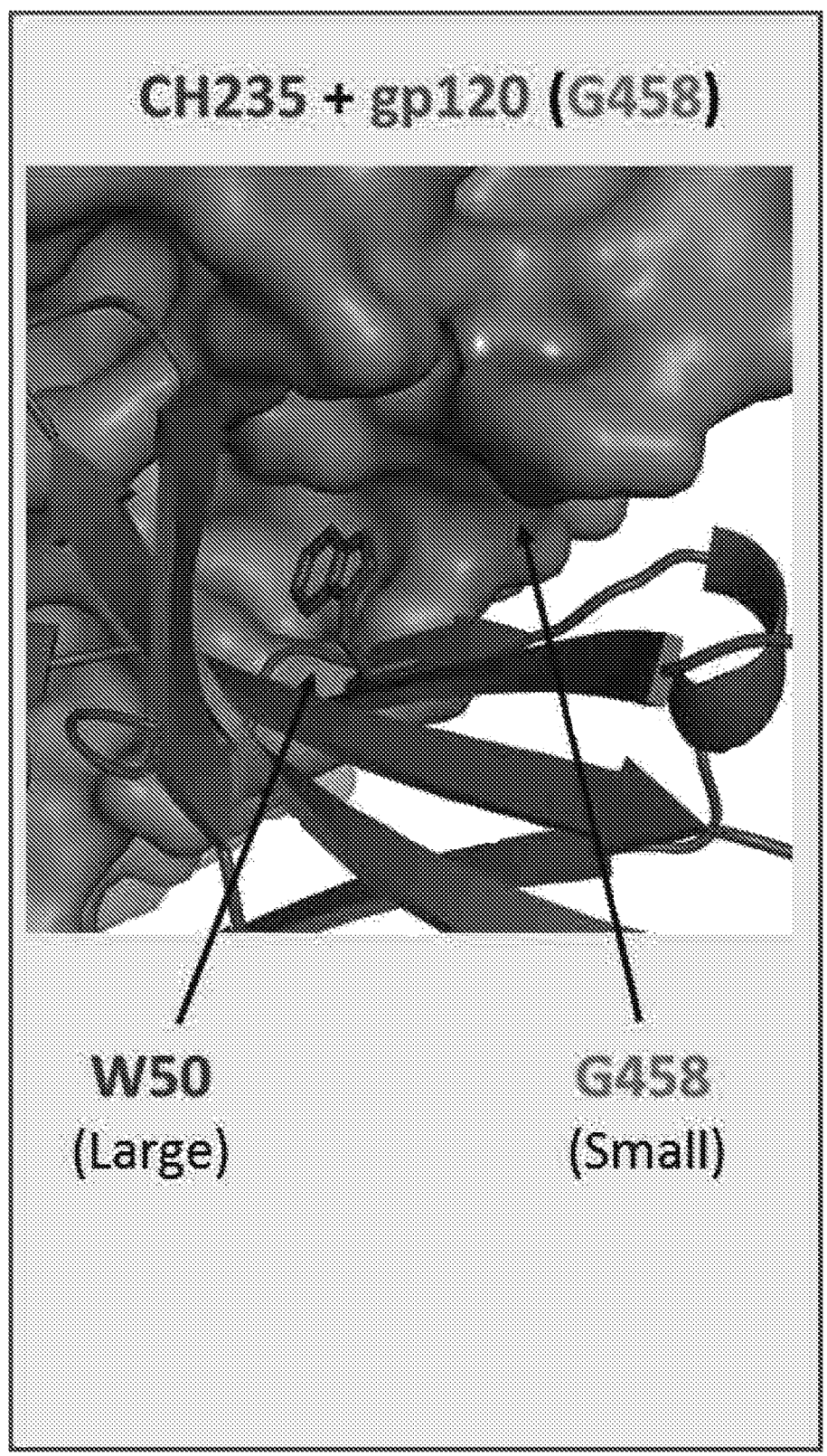
Figure 80B:
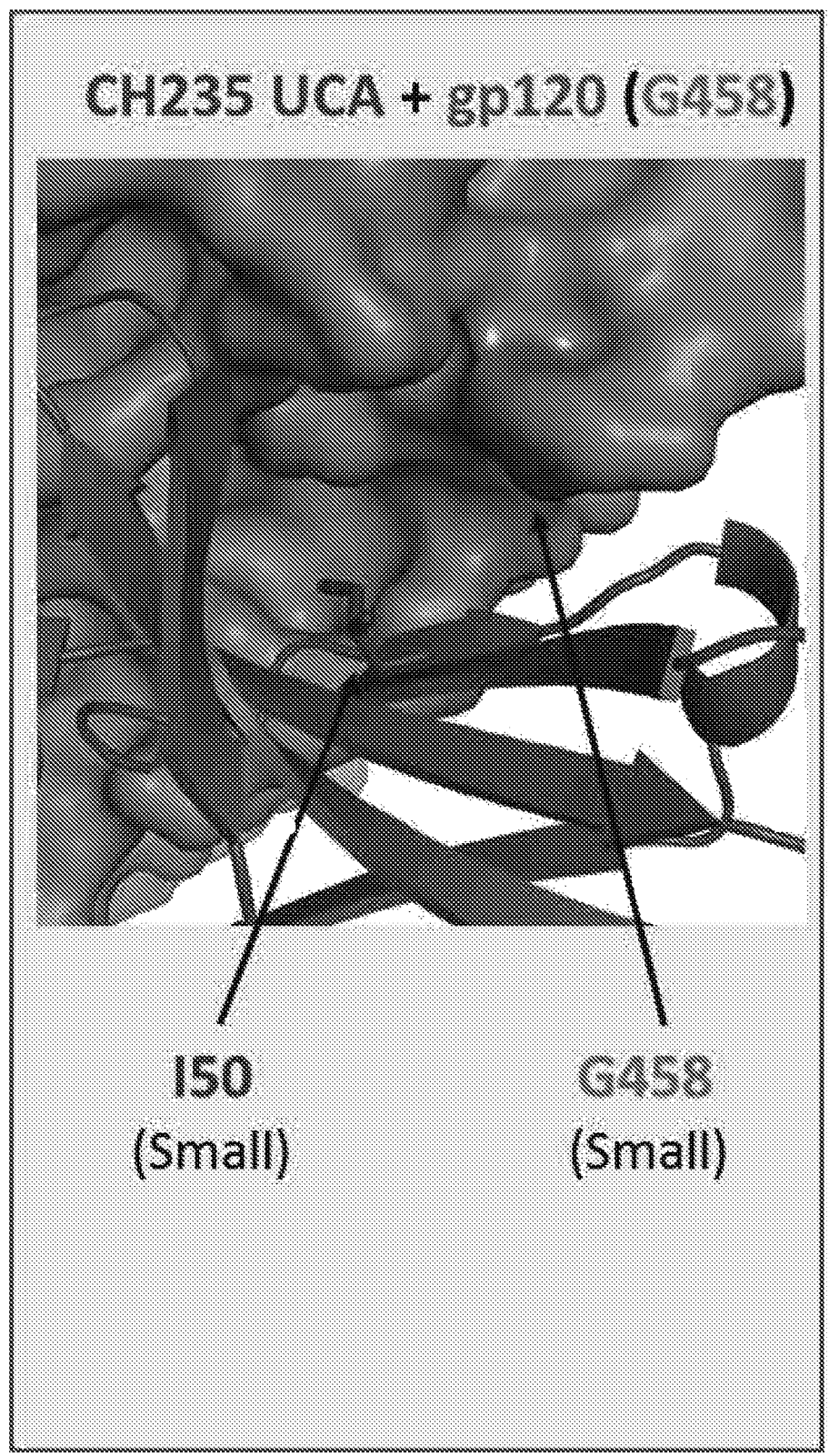
Figure 80C:
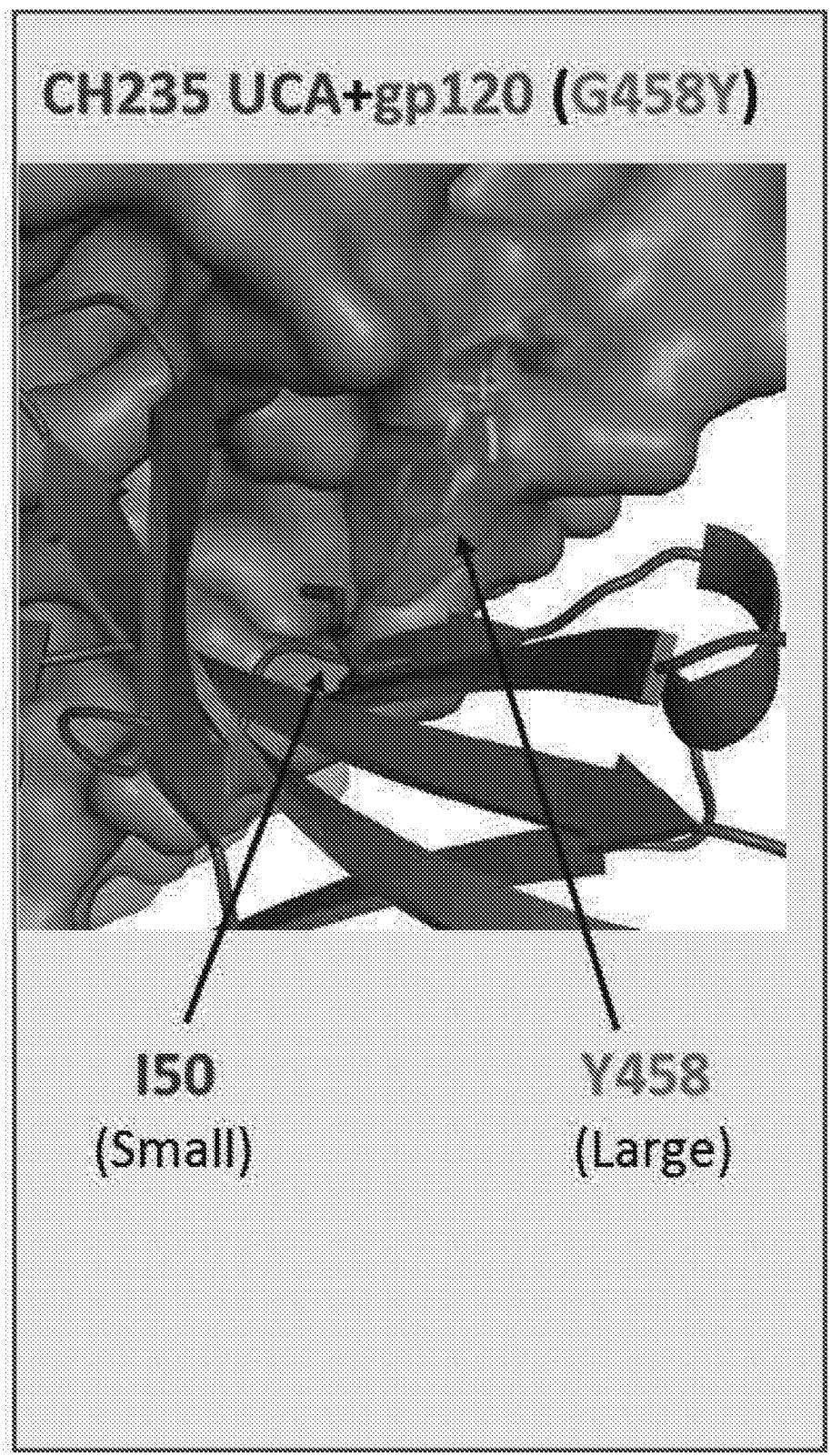

FIG. 80A-80C show structure and models of structure of CH235 antibodies and gp120 envelopes. FIG. 80A shows Crystal Structure of gp120 and CH235 (Ex. 8, published in Cell. 2016 Apr. 7; 165(2):449-63, PDB:5F9W). FIG. 80B shows a model of CH235 UCA antibody interaction with gp120. FIG. 80C shows a model of CH235 UCA antibody interaction with gp120 G458Y mutation. The figure shows a model of how G458Y provides improved contacts with ISO in CDRH2 of CH235 UCA heavy chain.

FIG. 81 shows amino acid sequences of envelopes with G458 mutation to Y (G458Y). FIG. 81 discloses SEQ ID NOS 422-461, 439, 438, 437, 441, 440, 462, 451, 450, 449, 448, 447, 463, 459, 458, 457, 461, 460, 464, 431, 430, 429, 428, 427, 465, 426, 425, 424, 423, 422, 466, 434, 433, 432, 436, 435, 467, 444, 443, 442, 446, 445, 468, 455, 456, 454, 453, 452 and 469, respectively, in order of appearance.

Figure 3A:
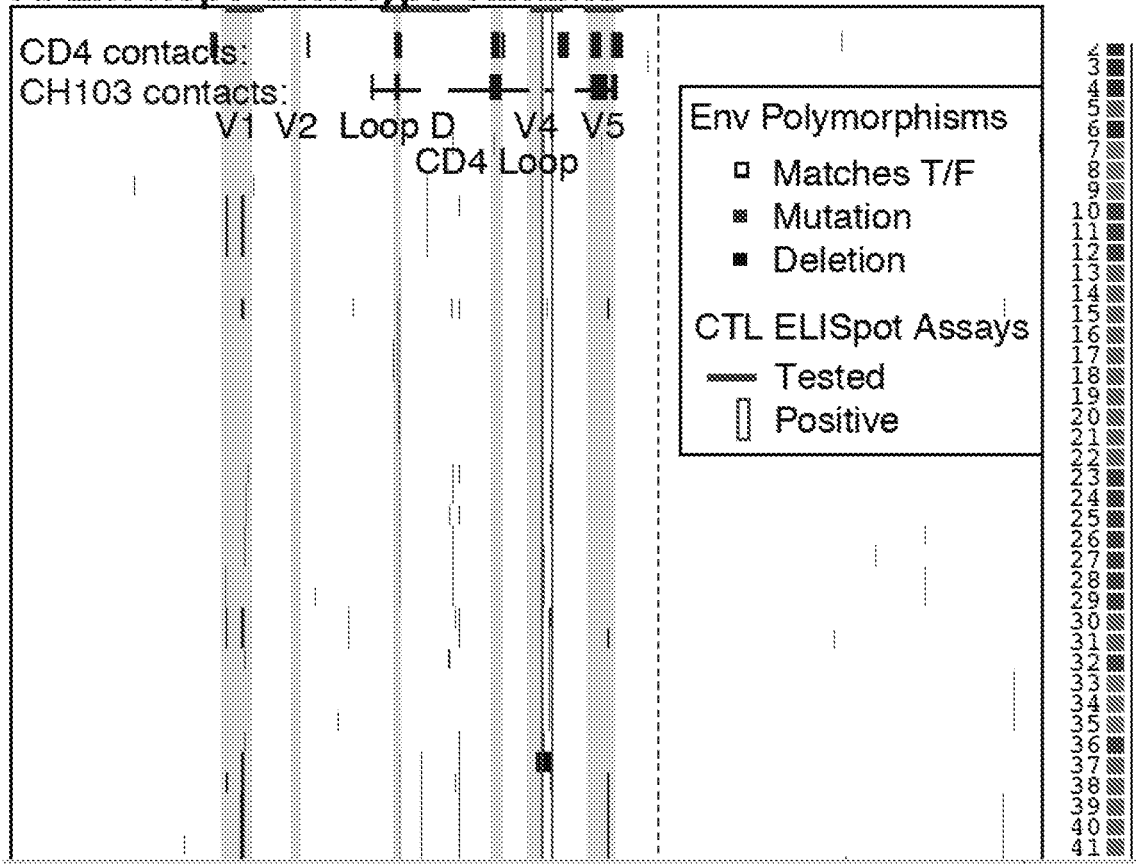
FIGS. 3A-C shows the genotype variation (A, left panel), neutralization titers (B, center panel), and Envelope phylogenetic relations (C, right panel) among CH505 Envelope variants. The vertical position in each panel corresponds to the same CH505 Env clone named on the right side of the tree. Distance from the Transmitted/Founder form generally increases from top towards bottom of the figure. In the left panel (A), sites not colored correspond to the Transmitted/Founder virus, red sites show mutations, and black sites correspond to insertions or deletions relative to the Transmitted/Founder virus. Additional annotation indicates the known CD4 binding-site contacts (short, vertical black bars towards top), CH103 binding-site contacts for the resolved structure (short, vertical blue bars with a horizontal line to indicate the region resolved by X-Ray Crystallography), gp120 landmarks (vertical grey rectangular regions, V1-V5 hypervariable loops, Loop D, and CD4 Loops), a dashed vertical line delineating the gp120/gp41 boundary, and results from testing for CTL epitopes with ELISpot assays (magenta bands at top and bottom show where peptides were tested and negative, and a magenta rectangle for the tested positive region outside the C-terminal end of V4). The center panel (B) depicts IC50 (50% inhibitory concentrations, in µg/ml) values from autologous neutralization assays against 13 monoclonal antibodies (MAbs) of the CH103 lineage and each of 134 CH505 Env-pseudotyped viruses. Color-scale values indicate neutralization potency and range from grey (no neutralization detected) through dark red (potent neutralization, i.e. <0.2 µg/ml; empty cells correspond to absence of information). The cumulative progression of neutralization potency from left to right, corresponding to developmental stages in the CH103 lineage, indicates accumulation of neutralization potency. Similarly, increased presence neutralization signal from top to bottom corresponds to increasing neutralization breadth per MAb in the CH103 lineage. In the right-most panel (C) is the phylogeny of CH505 Envs, with the x-axis indicating distance from the Transmitted-Founder virus per the scale bar (units are mutations per site). The tree is ordered vertically such that lineages with the most descendants appear towards the bottom. Each leaf on the tree corresponds to a CH505 autologous Env, with the name of the sequence depicted ('w' and symbol color indicate the sample time-point; 'M' indicates a synthetic mutant Env). The color of text in each leaf name indicates its inclusion in a possible embodiment, or grey for exclusion from any embodiments described herein. Three long, vertical lines to the left of the tree depict the phylogenetic distribution of envelopes in three distinct alternative embodiments (identified as "Vaccination Regimes 1-3"), with diamonds used to identify each.
Figure 3A:
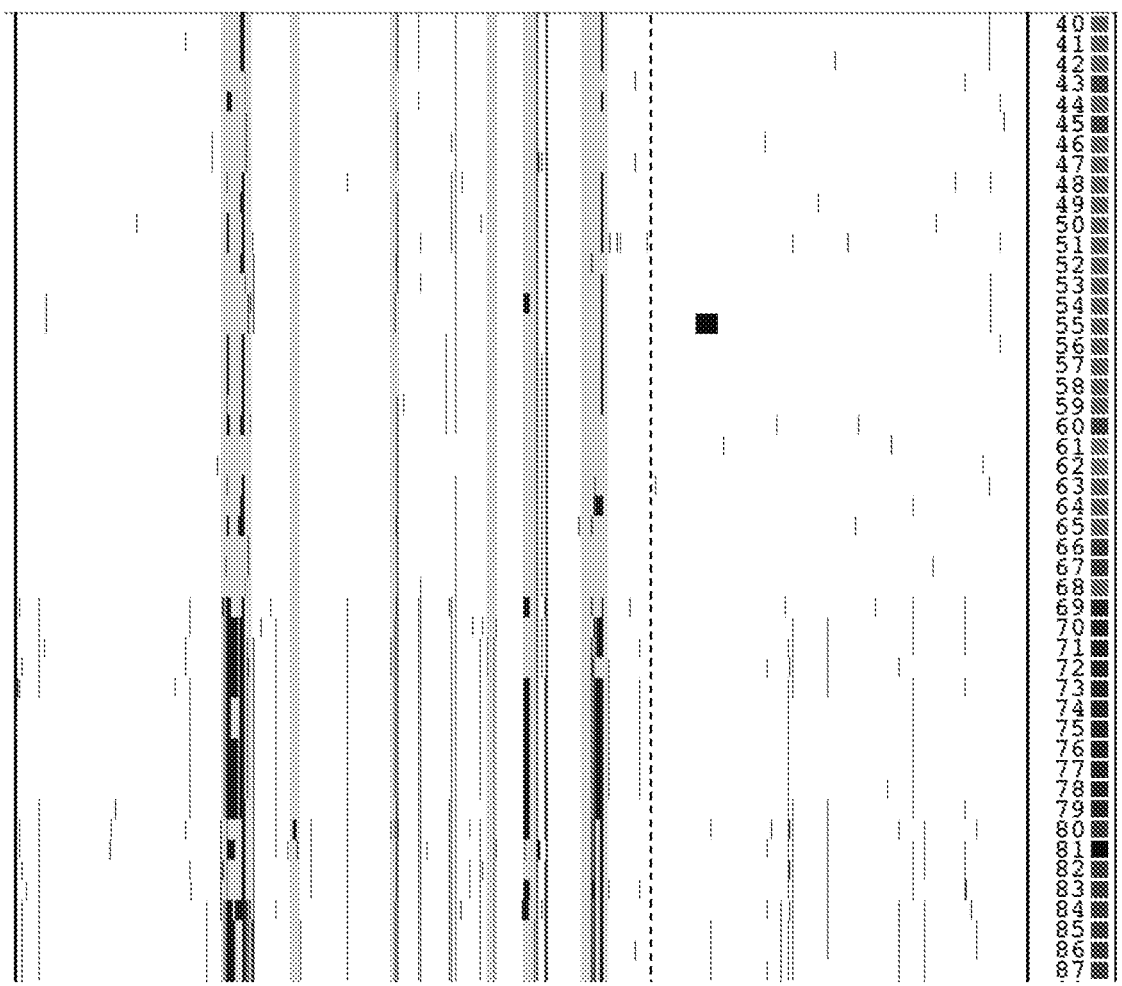
Figure 3A:
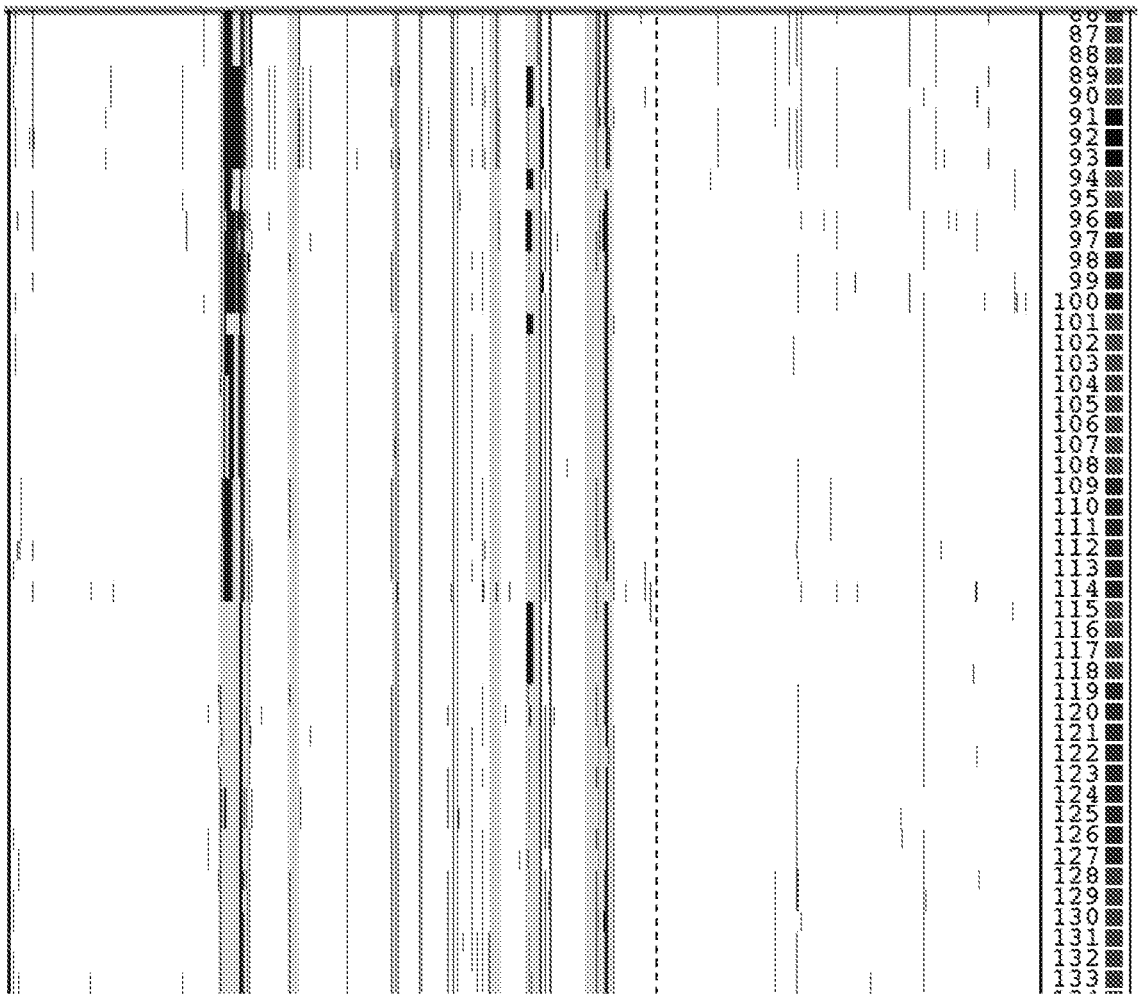
Figure 3A:
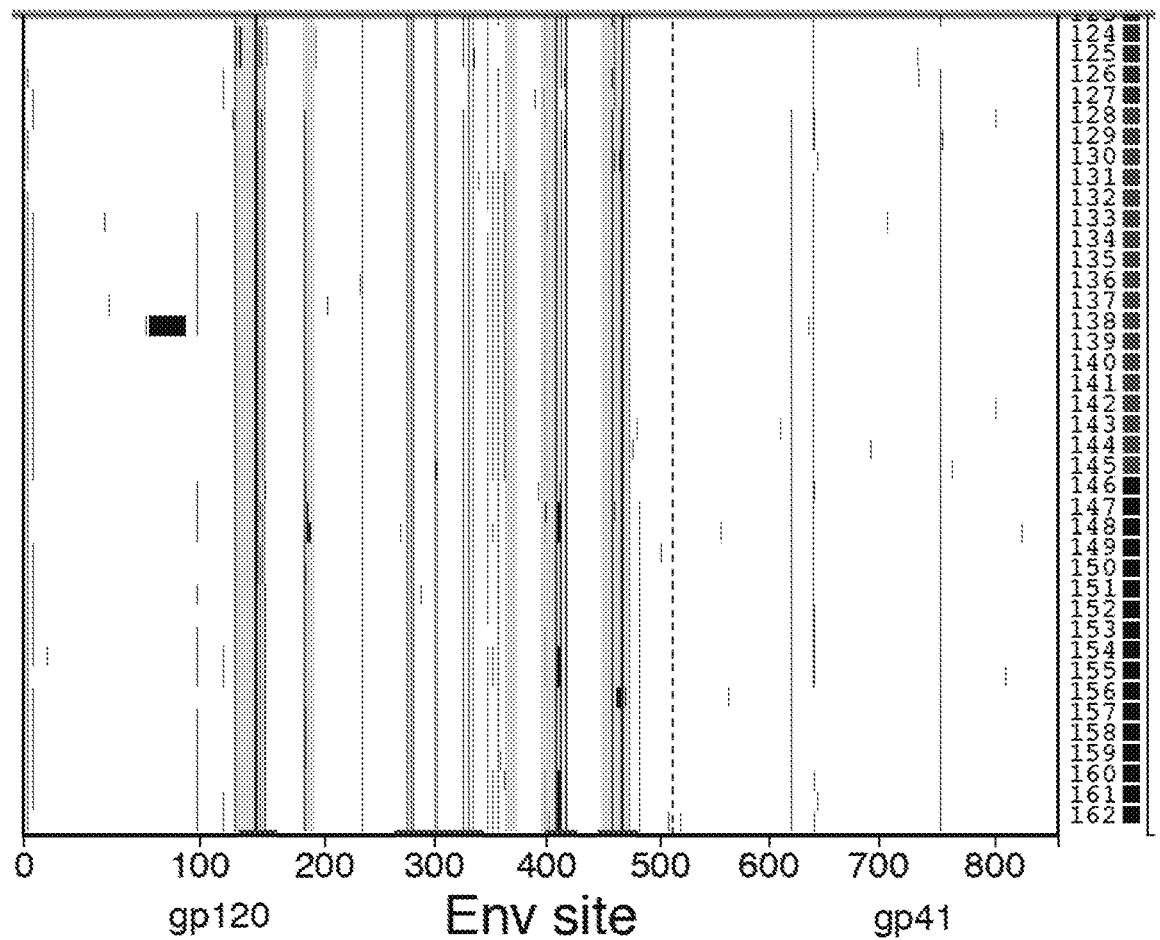
Figures 3B, 3C:
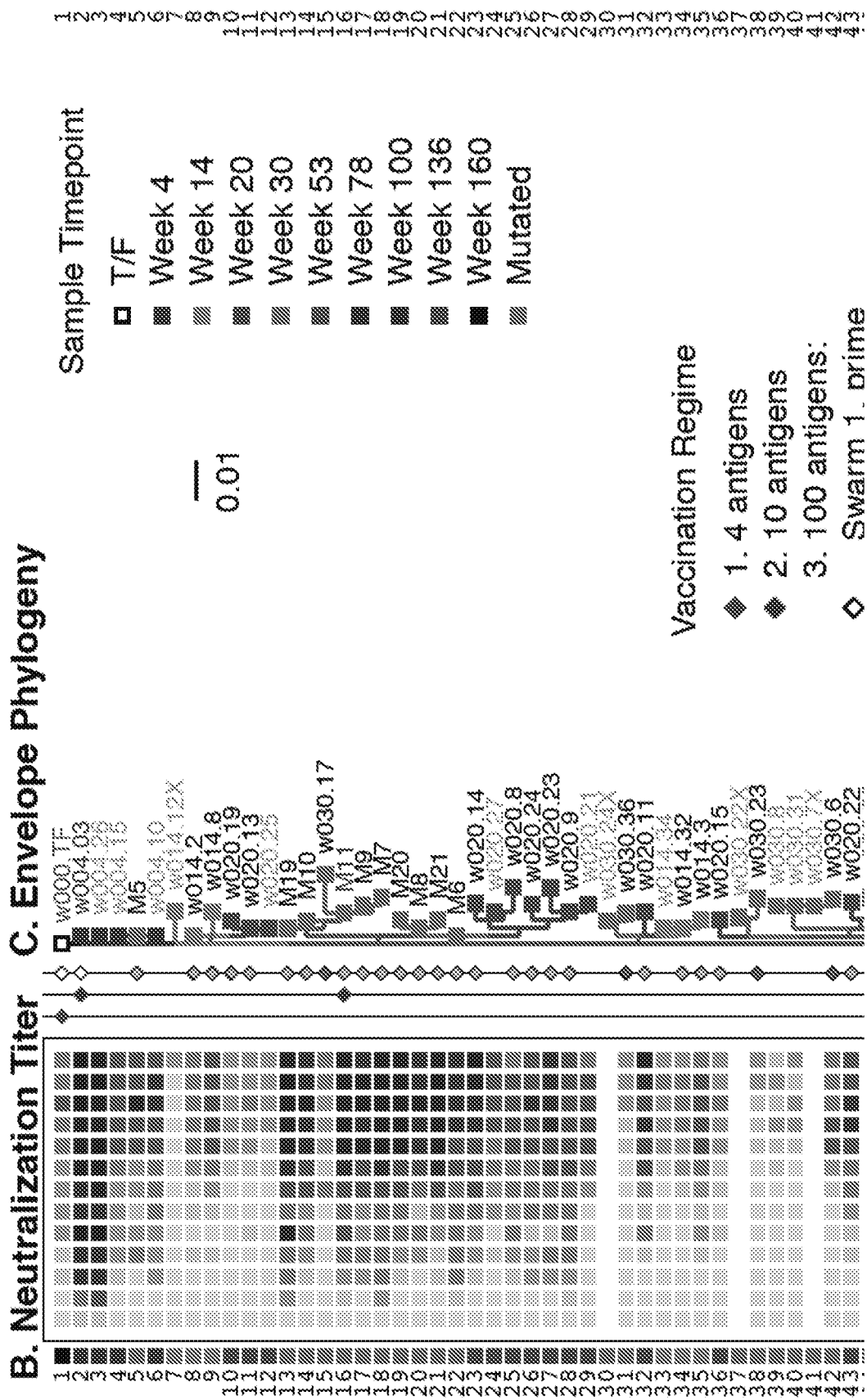
Figures 3B, 3C:
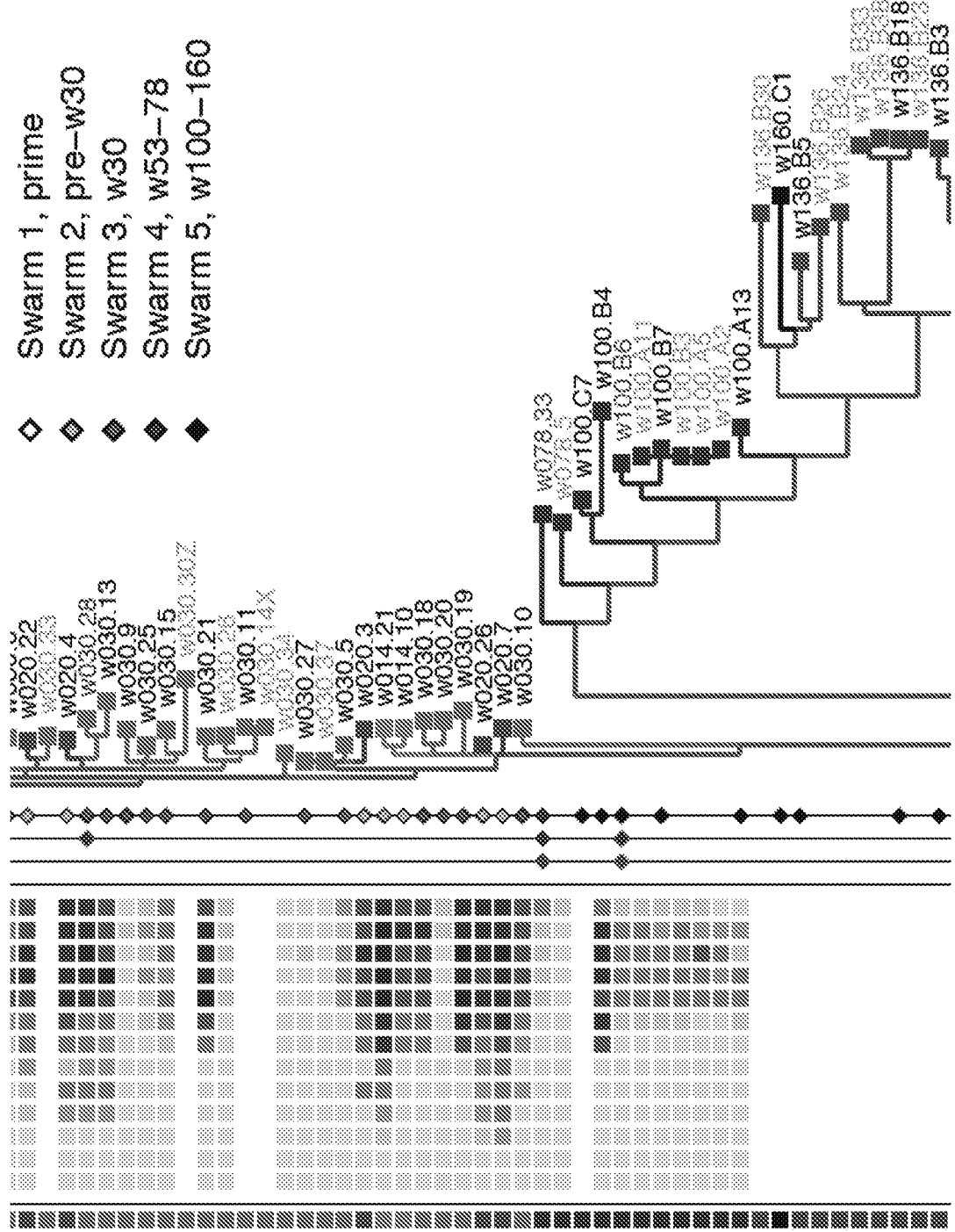
Figures 3B, 3C:
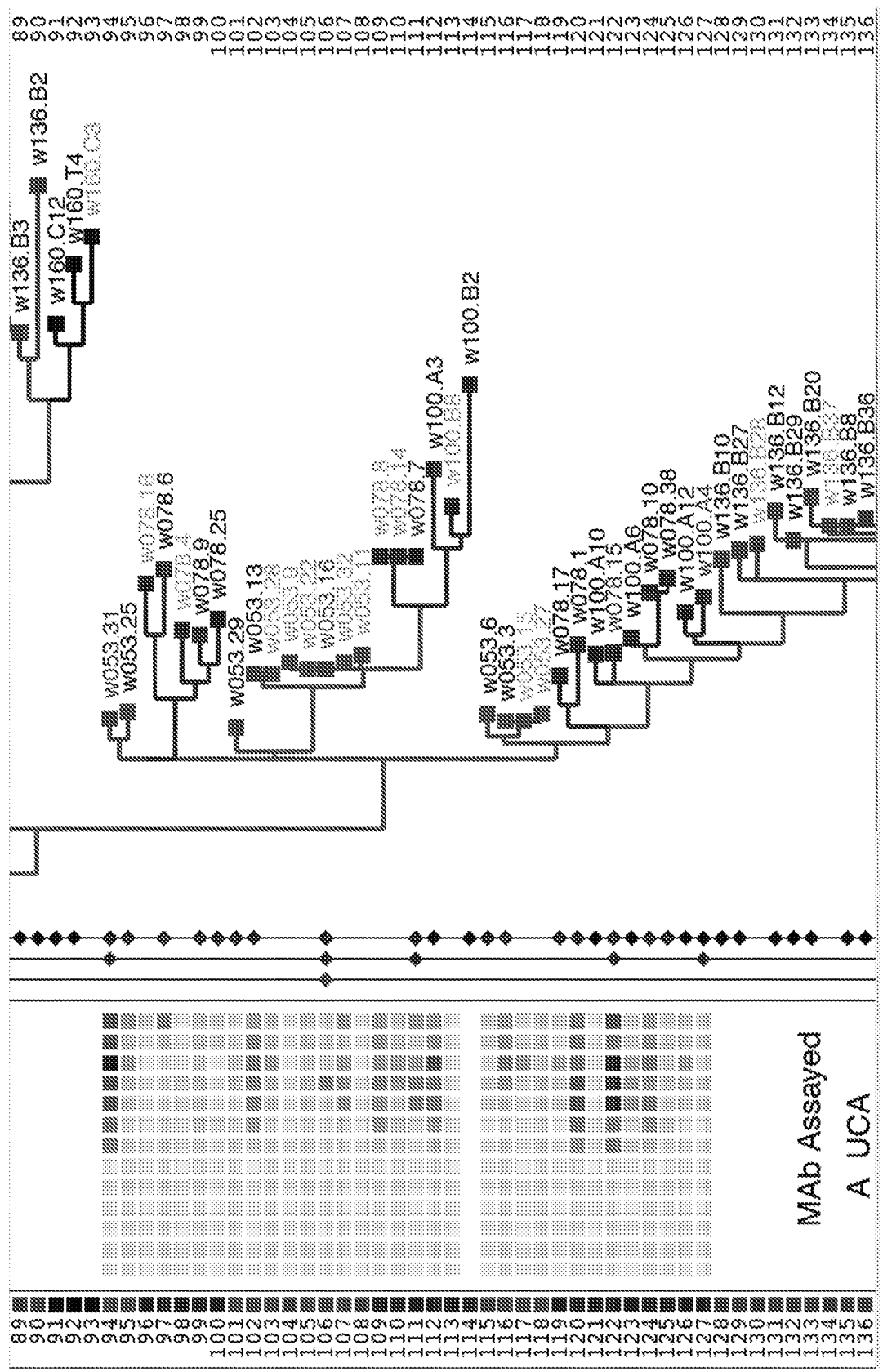
Figures 3B, 3C:
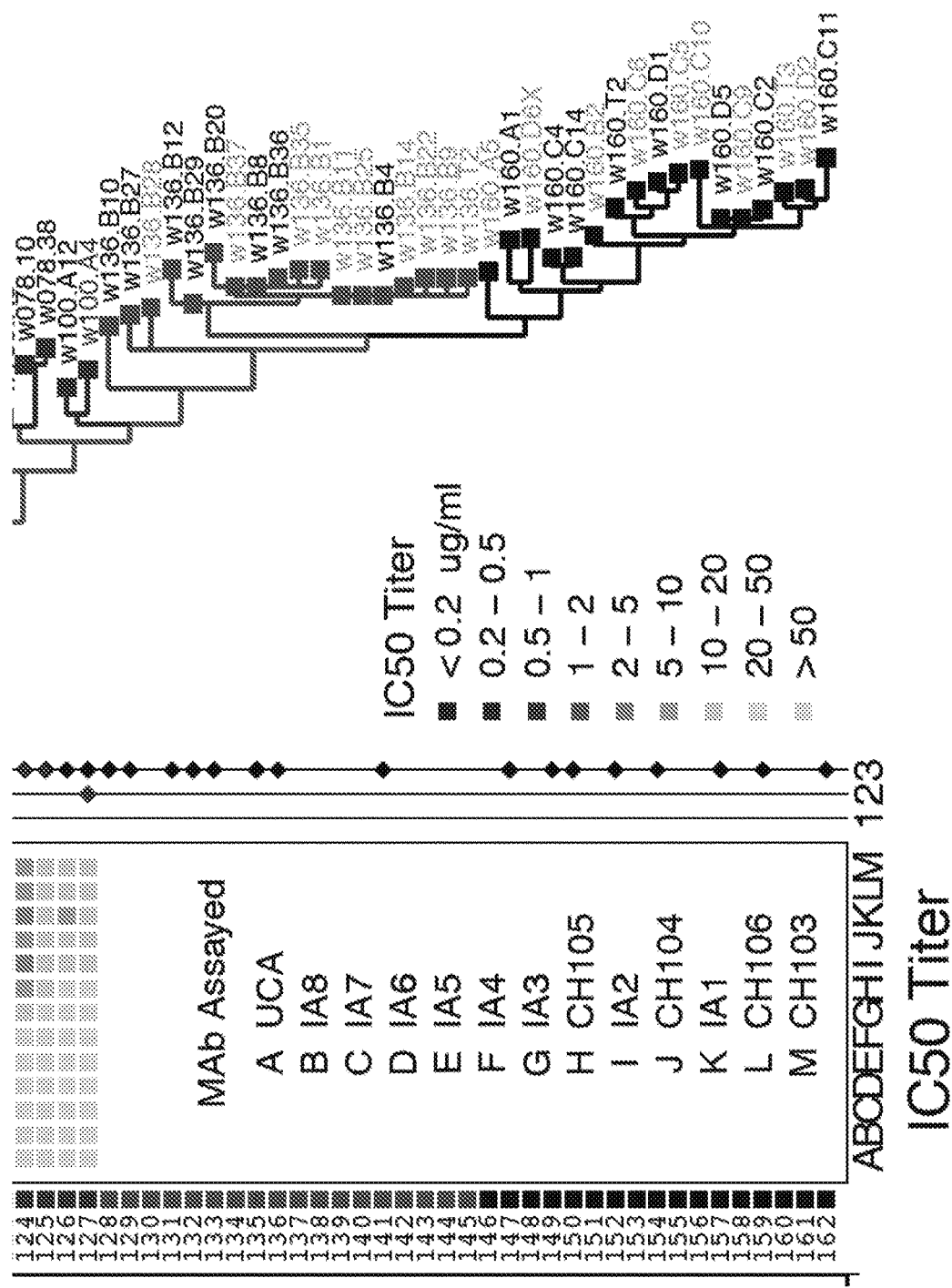
Figure 4:
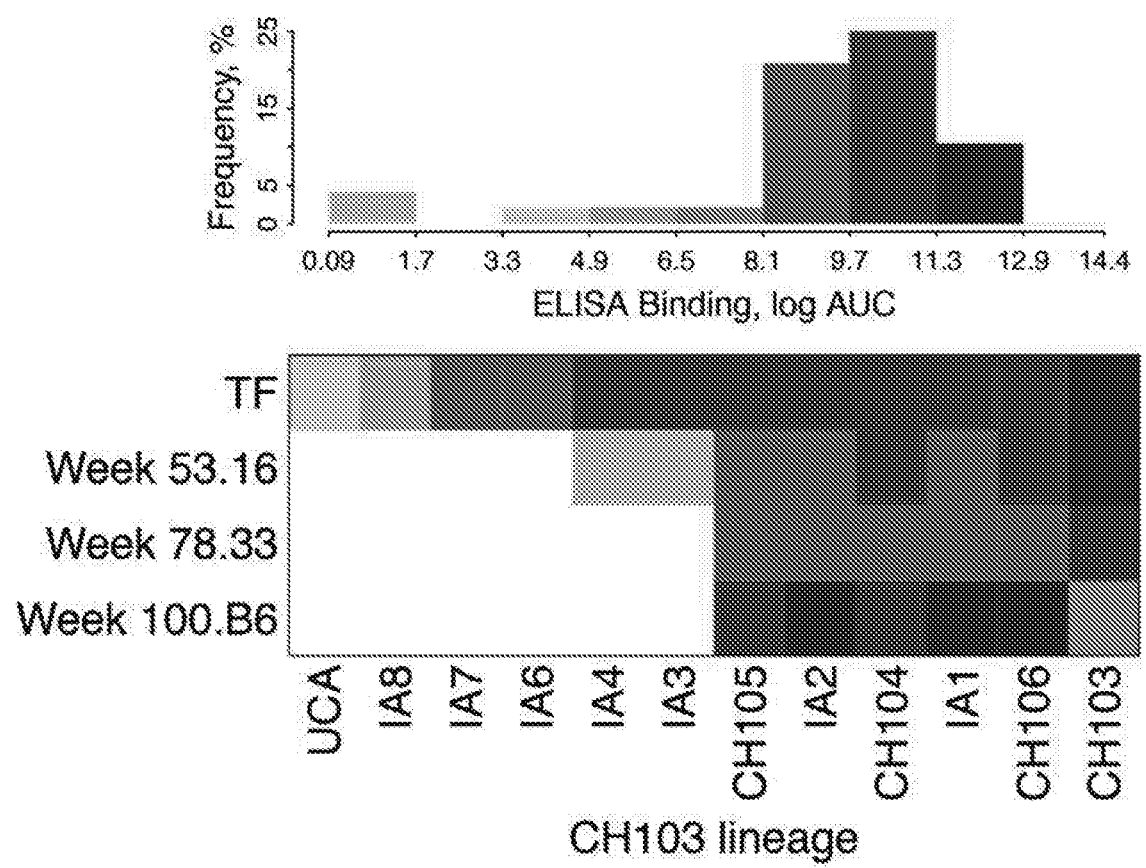
FIGS. 4-8 show Heat Map of Binding (log Area Under the Curve, AUC) of Sequential Envs to CH103 and CH235 CD4 Binding Site Broadly Neutralizing Antibody Lineages members. Numerical data corresponding to the graphic representations in these figures are shown in Tables 2-5 in Example 2.
Figure 5:
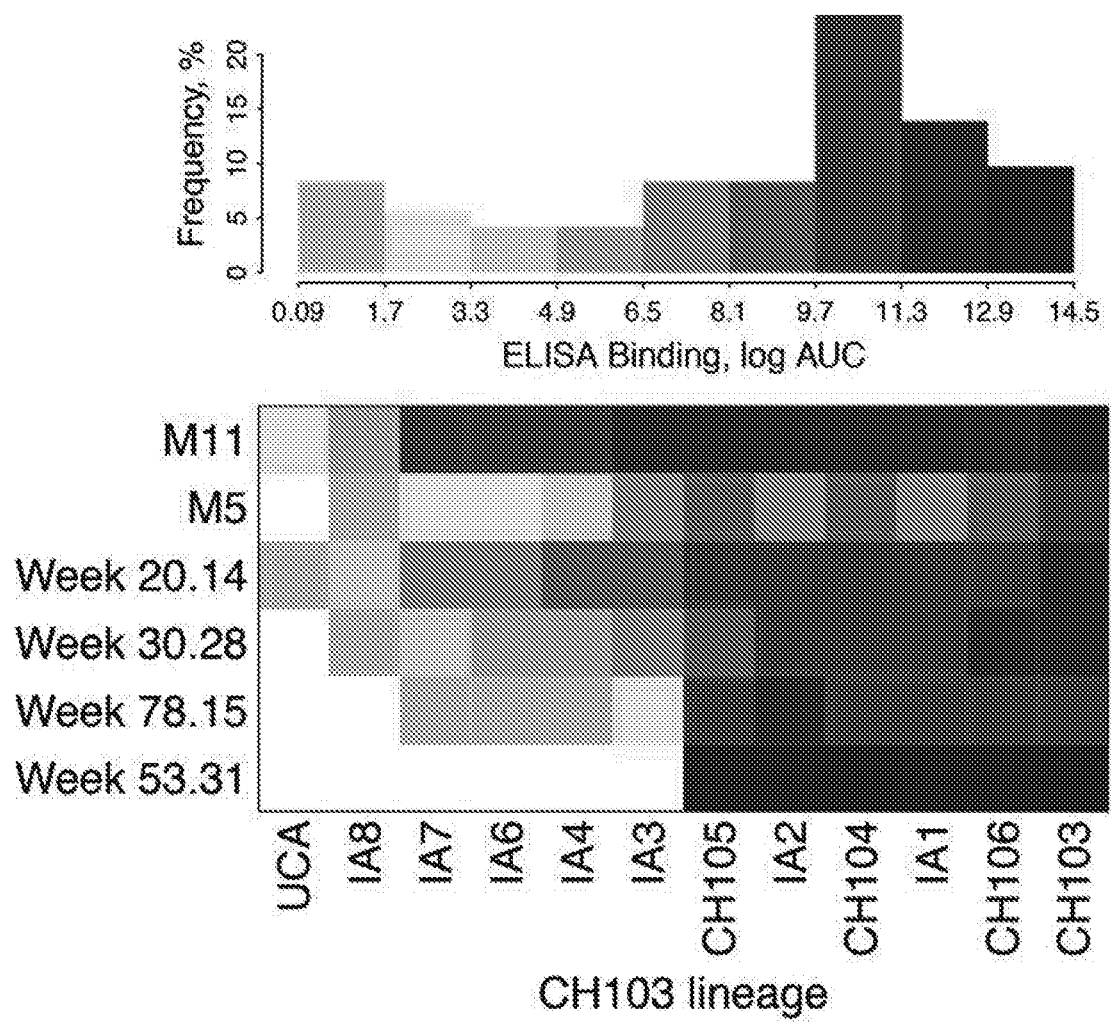
Figure 6:
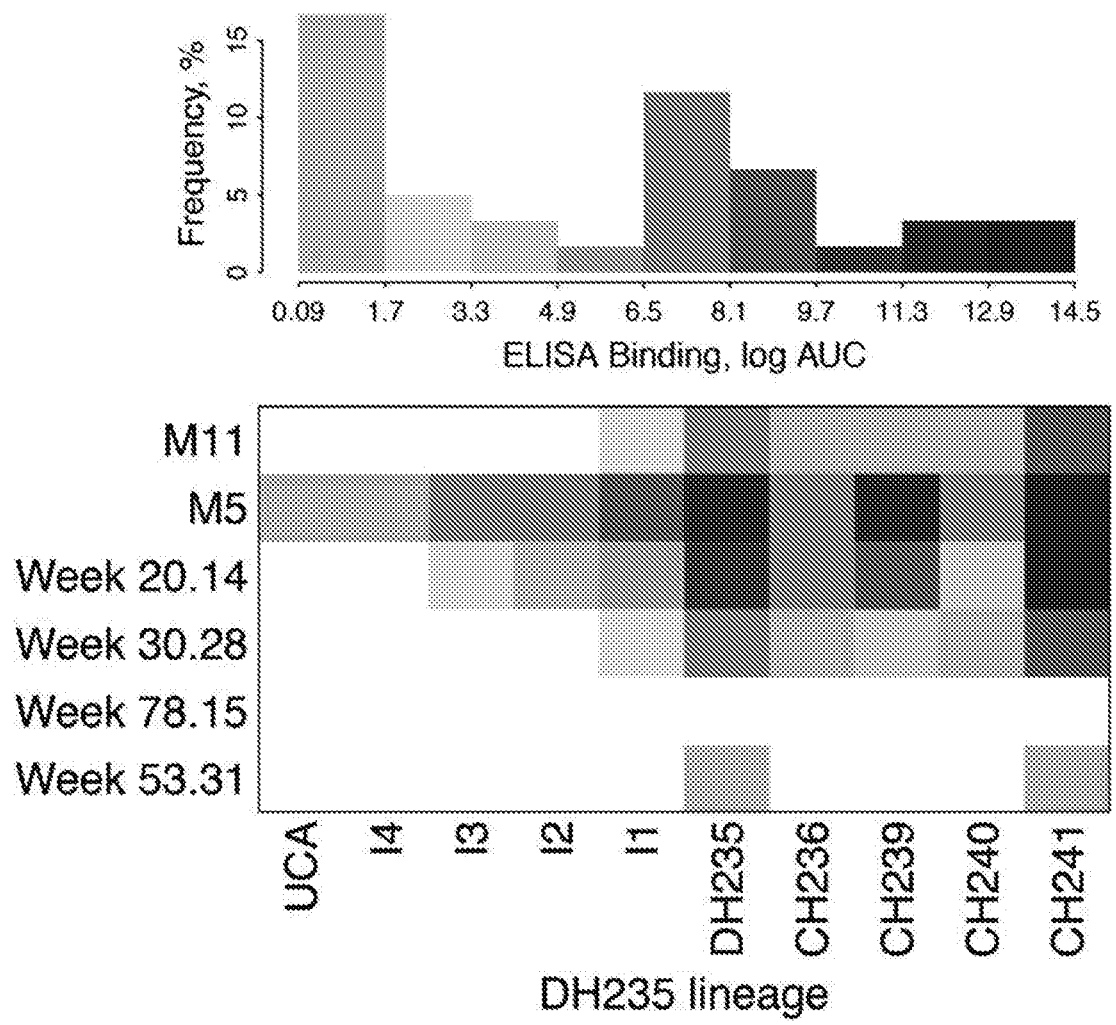
Figure 7:
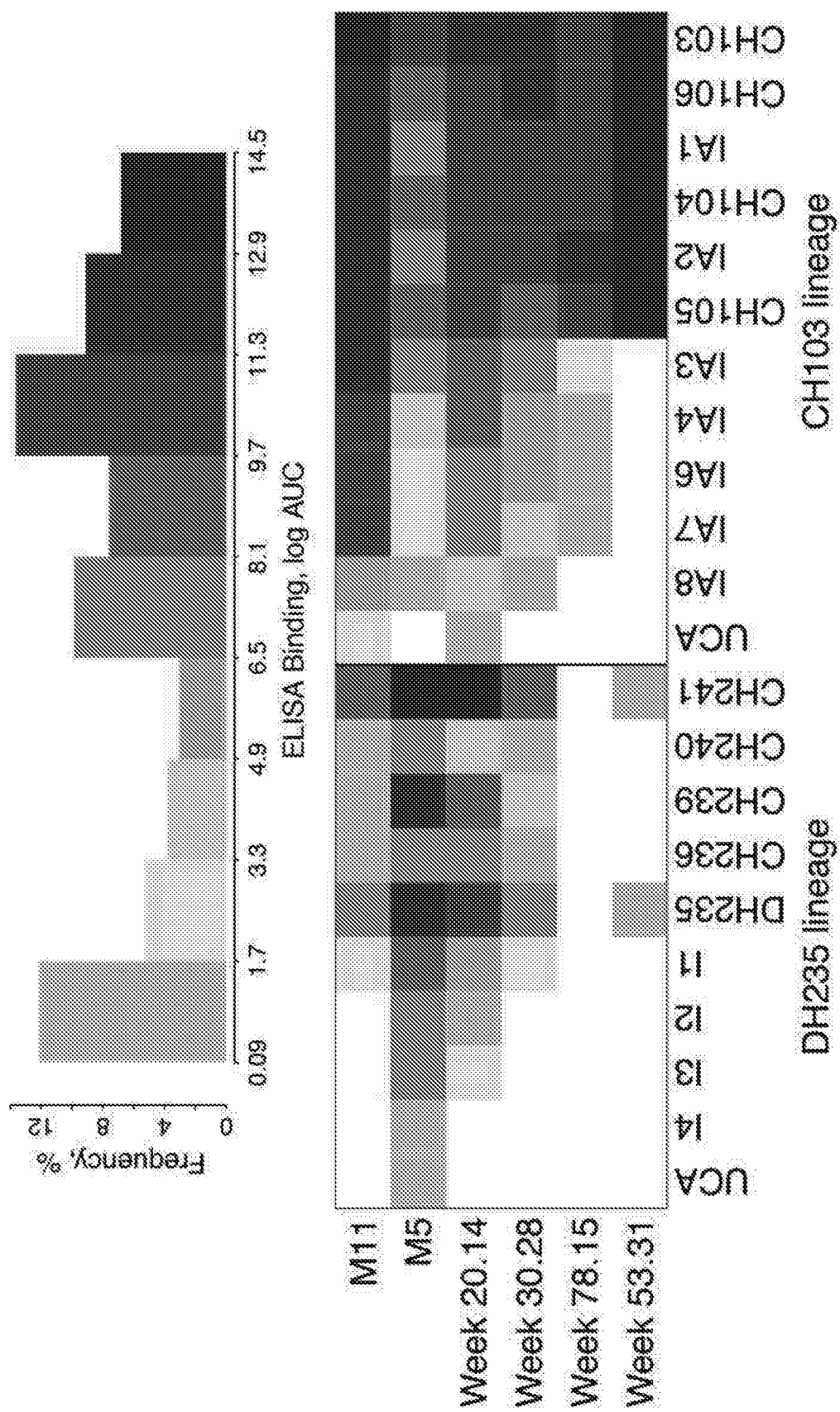
Figure 8:
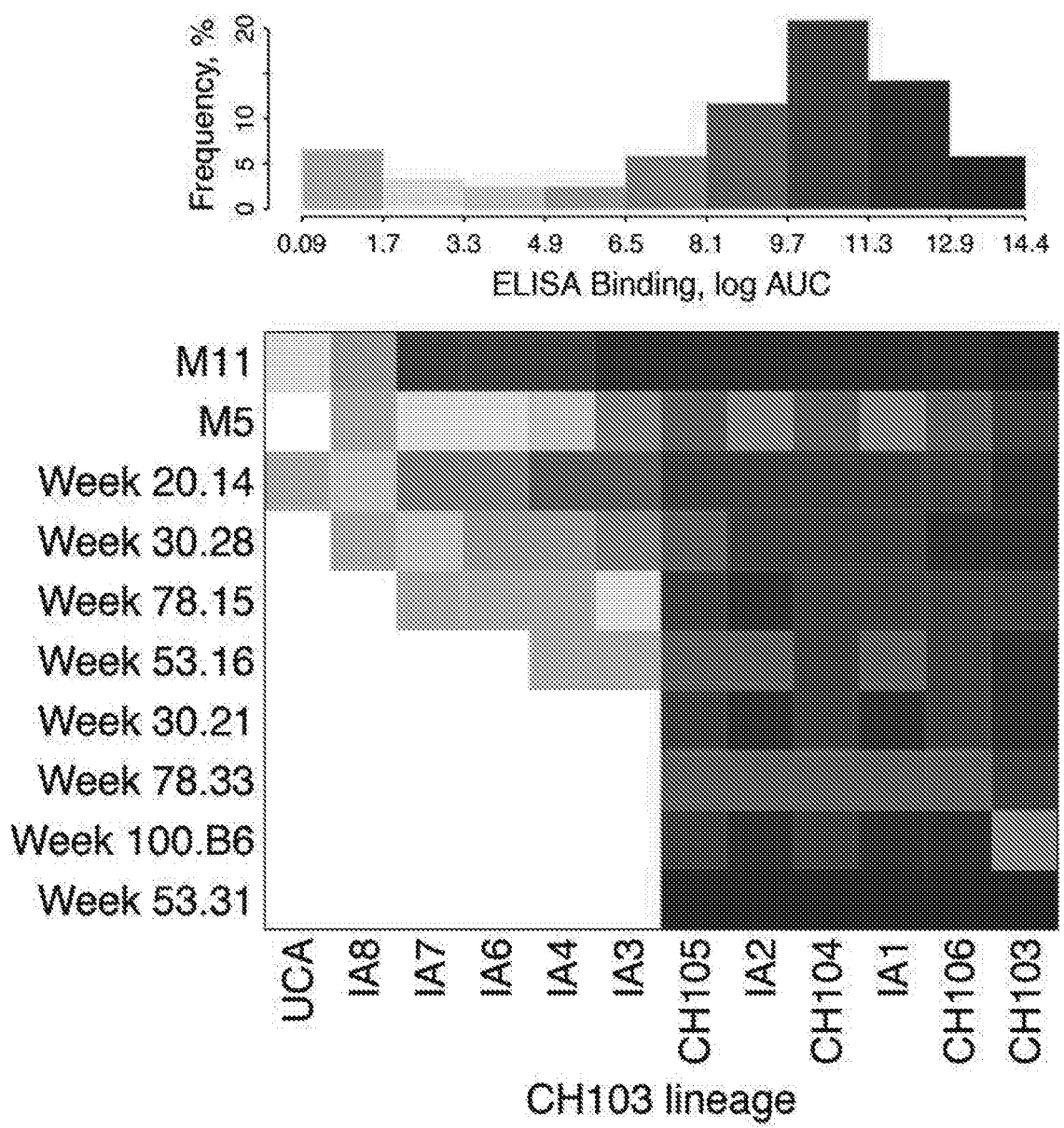
Figure 11:
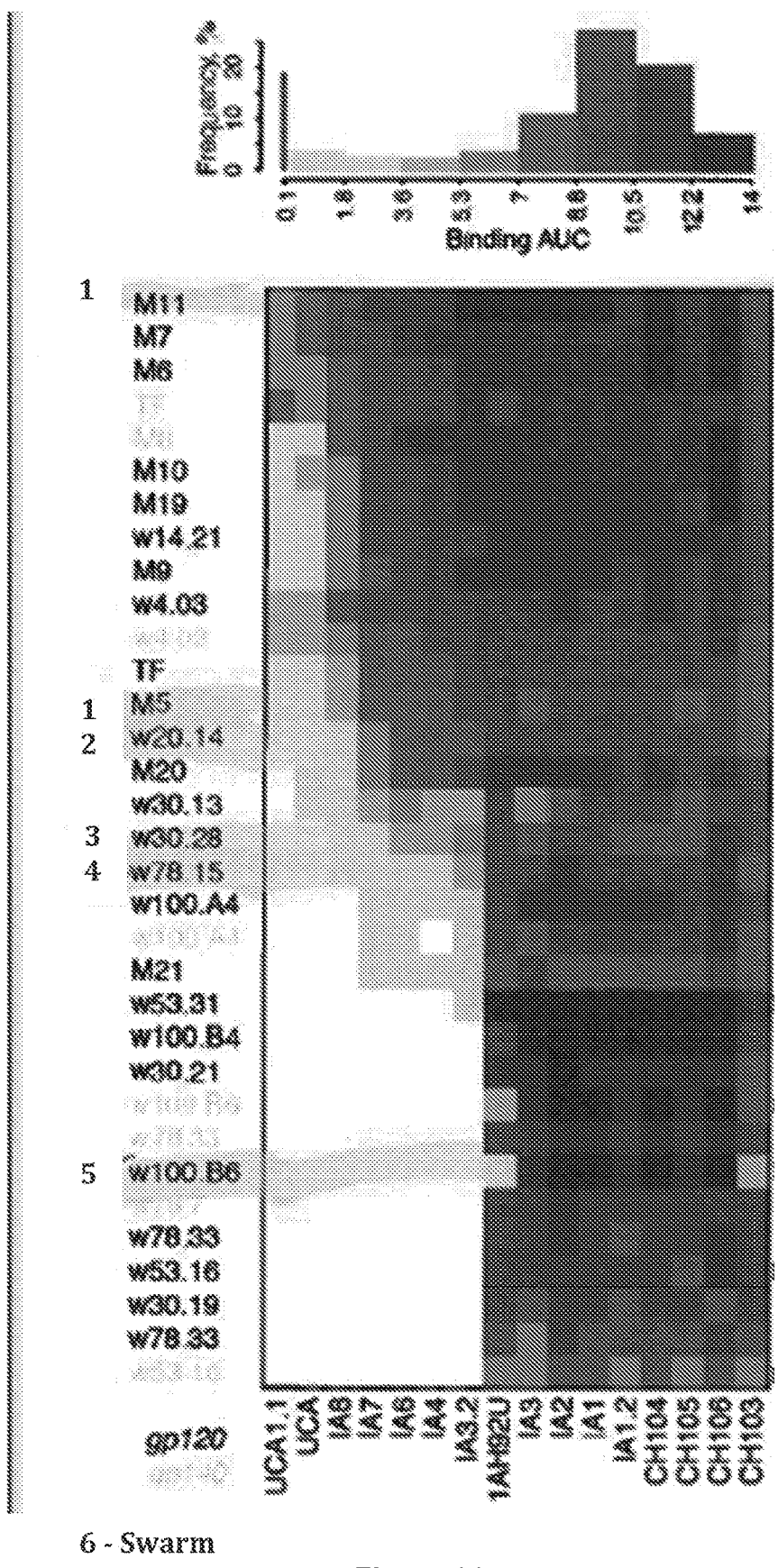
FIG. 11 shows CH103 ELISA binding data and choice of immunogens.
Figure 11:
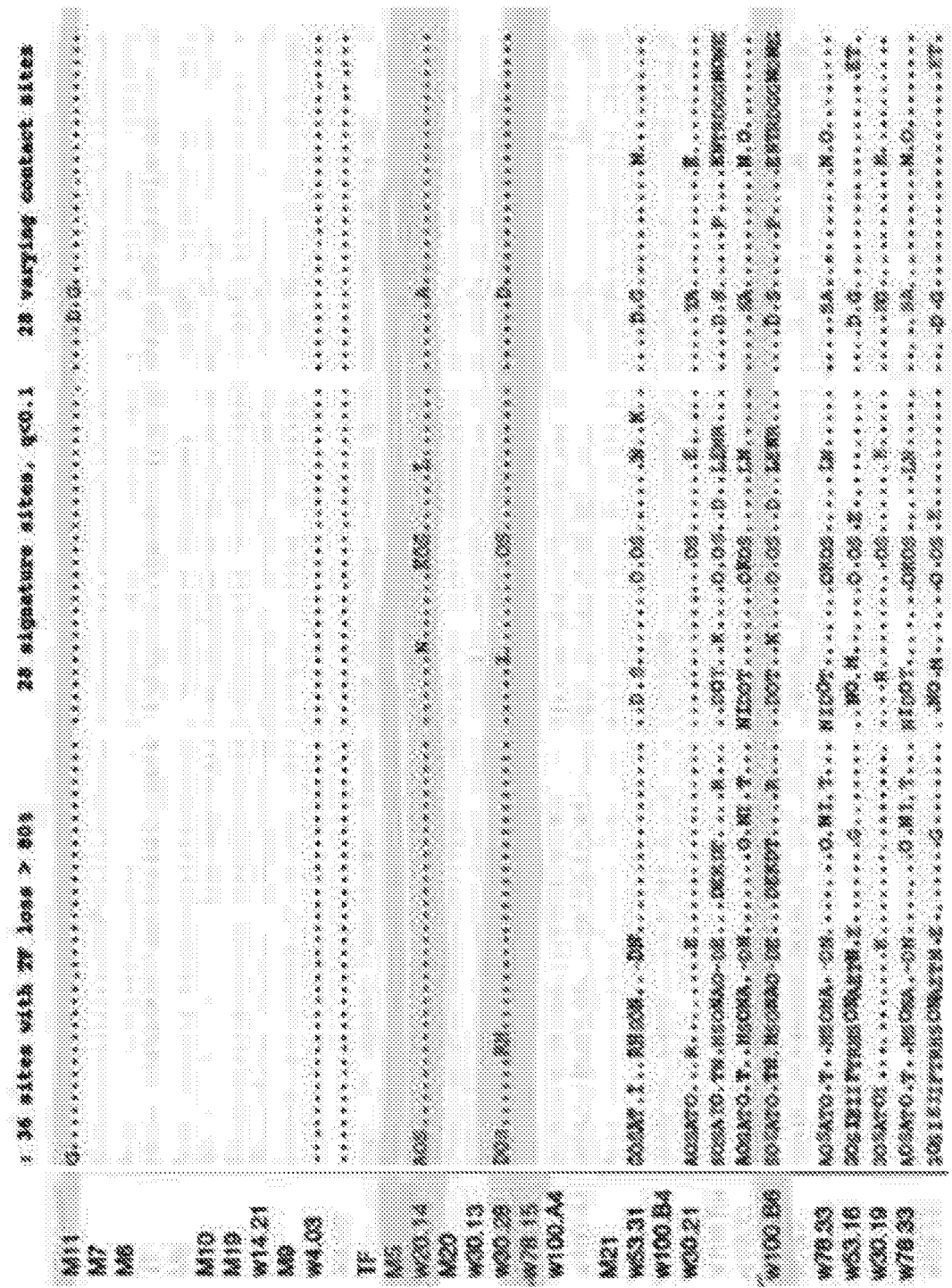
Figure 14A:
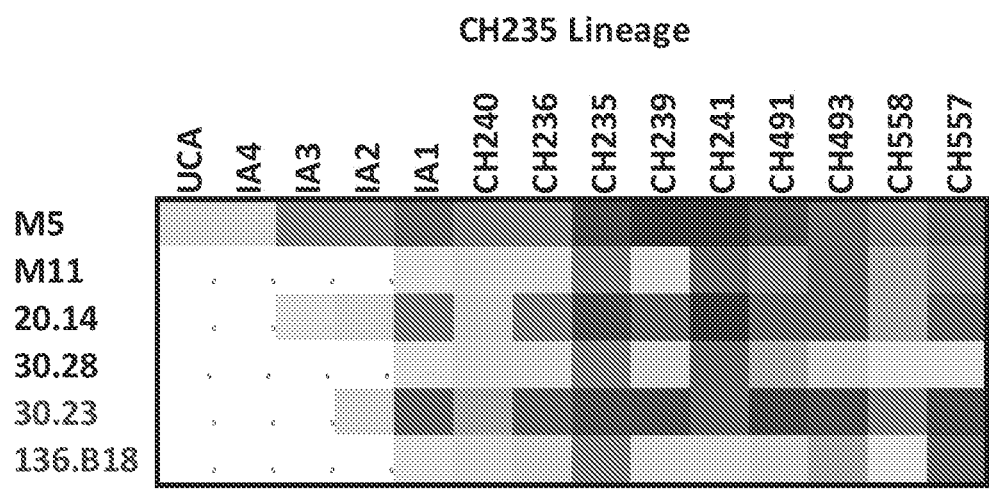
FIGS. 14A-B show a heat map of binding log Area Under the Curve, AUC) of Sequential Envs M5, M11, 20.14, 30.28, 30.23, 136.B18 to CH103 (FIG. 14B) and CH235 (FIG. 14A-includes lineage member CH557) CD4 Binding Site Broadly Neutralizing Antibody Lineages members.
Figure 14B:
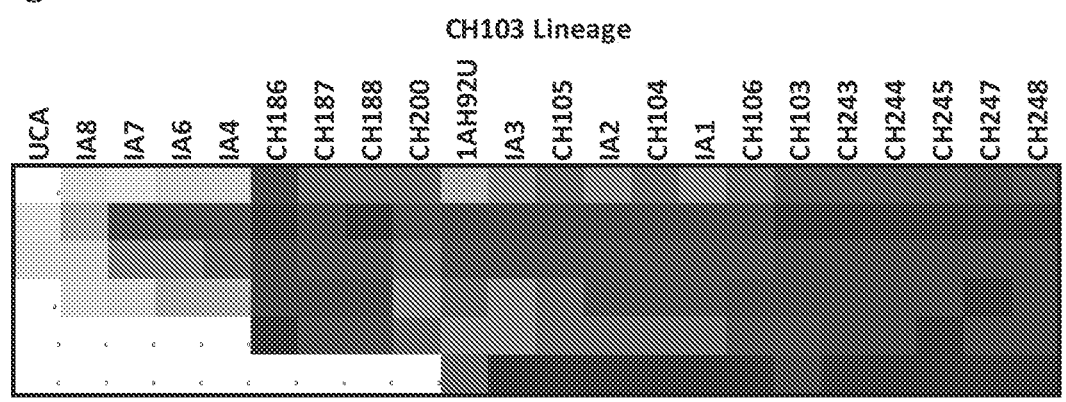
Figure 15A:
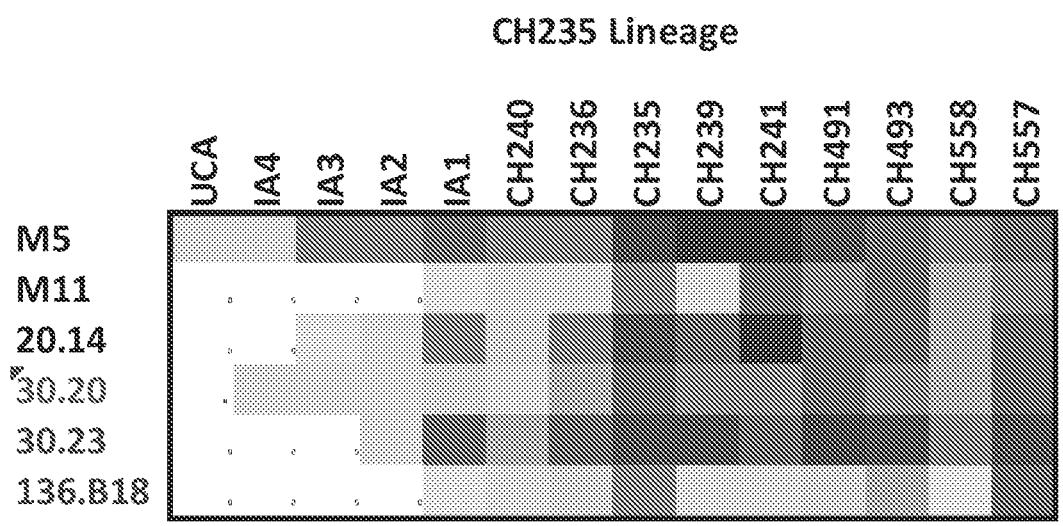
FIGS. 15A-B show a heat map of binding log Area Under the Curve, AUC) of Sequential Envs M5, M11, 20.14, 30.20, 30.23, 136.B18 to CH103 (FIG. 15B) and CH235 (FIG. 15A-includes lineage member CH557) CD4 Binding Site Broadly Neutralizing Antibody Lineages members. Env 30.20 has better progression for CH235 whereas 30.28 has better progression for CH103, however early CH103 intermediates are covered well by 20.14.
Figure 15B:
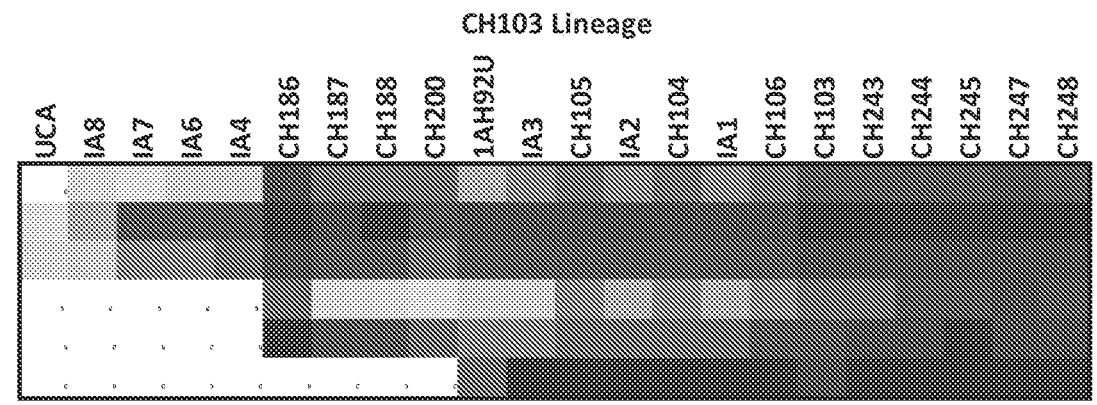
Figures 18A, 18B:
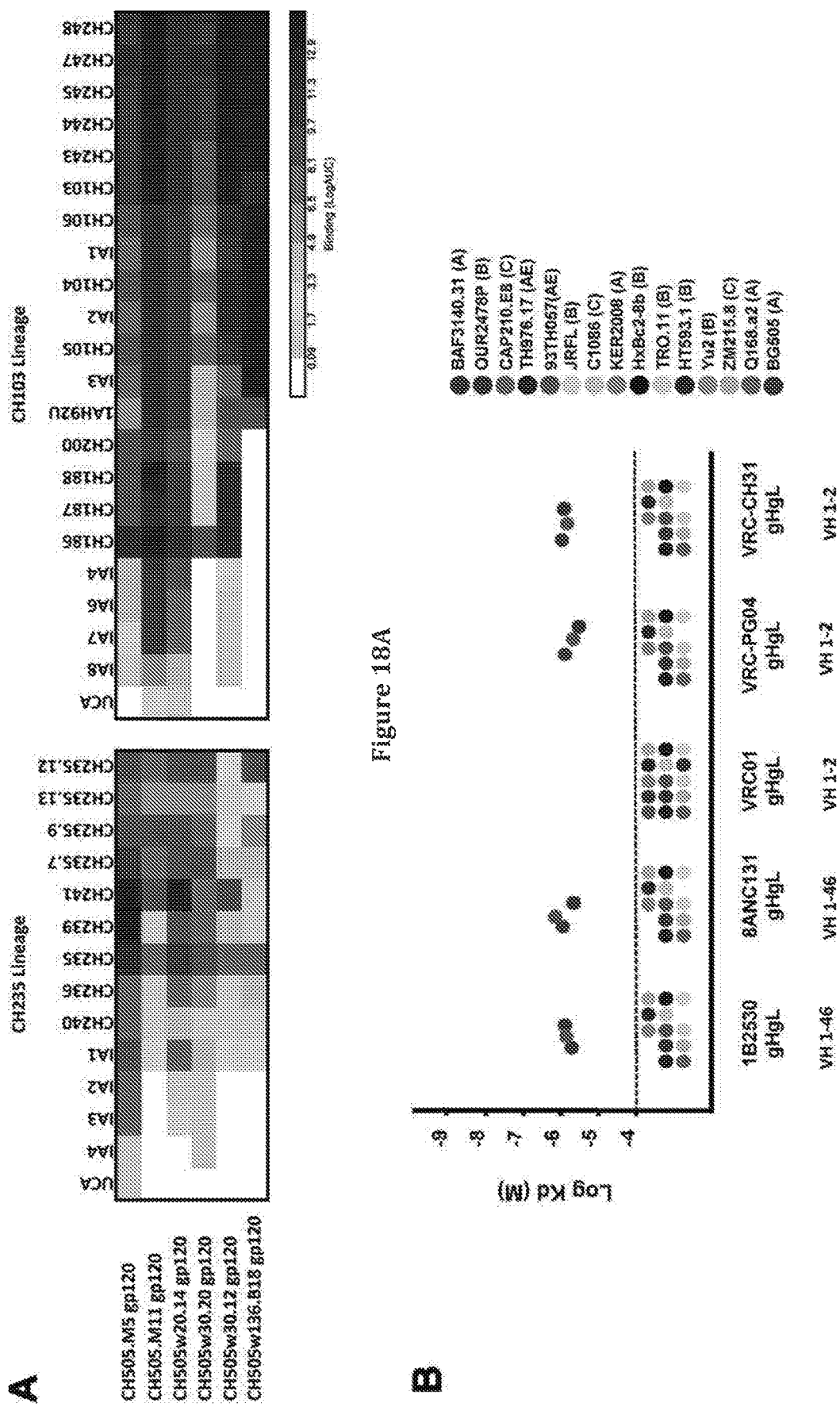
FIGS. 18A-B (see also FIGS. 52A-B from Example 8) show. CH505 gp120 Env Quasi-species Selected as Optimized Immunogens to Induce Both CH235 and CH103-like bnAbs, related to FIGS. 46A-B (Ex. 8). (A) Heatmap of the binding data of selected CH235 and CH103 lineage members to the CH505 Env glycoproteins selected to be used as immunogens. Individual Env clone names and weeks of isolation are shown on the left. (A) shows a binding log Area Under the Curve, AUC) of Sequential Envs M5, M11, 20.14, 30.20, 30.12, 136.B18 to CH235 (left panel) and CH103 (right panel) CD4 Binding Site Broadly Neutralizing Antibody Lineages members. (B) Affinity of gHgL of 1B2530, 8ANC131, VRC01, VRC-PG04 and VRC-CH31 to a panel of 15 heterologous gp120 envelope glycoproteins.

FIG. 82 shows one embodiment of nucleic acid sequences encoding gp160 envelopes of FIG. 7. FIG. 82 discloses SEQ ID NOS 470-477, respectively, in order of appearance.

Figure 83A:
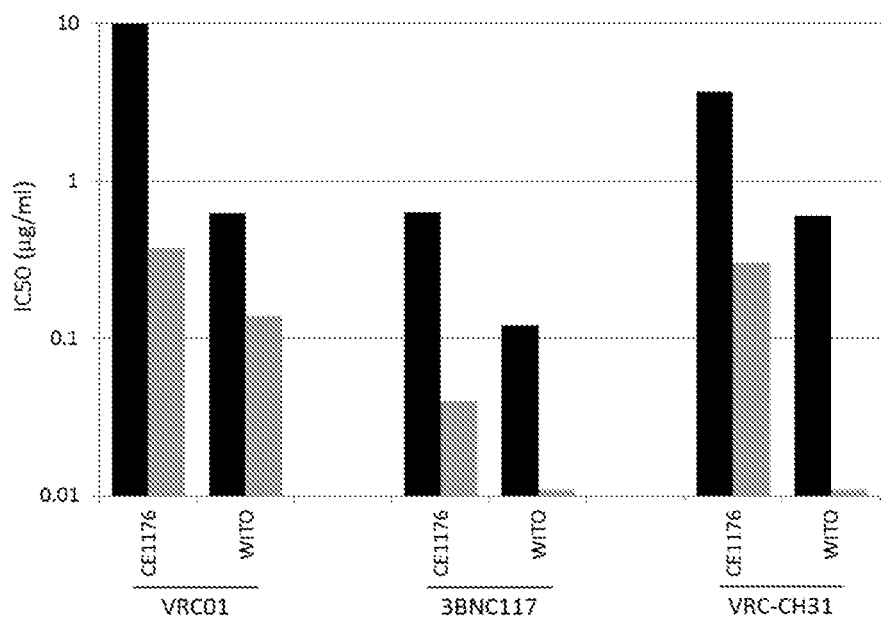
Figure 83B:
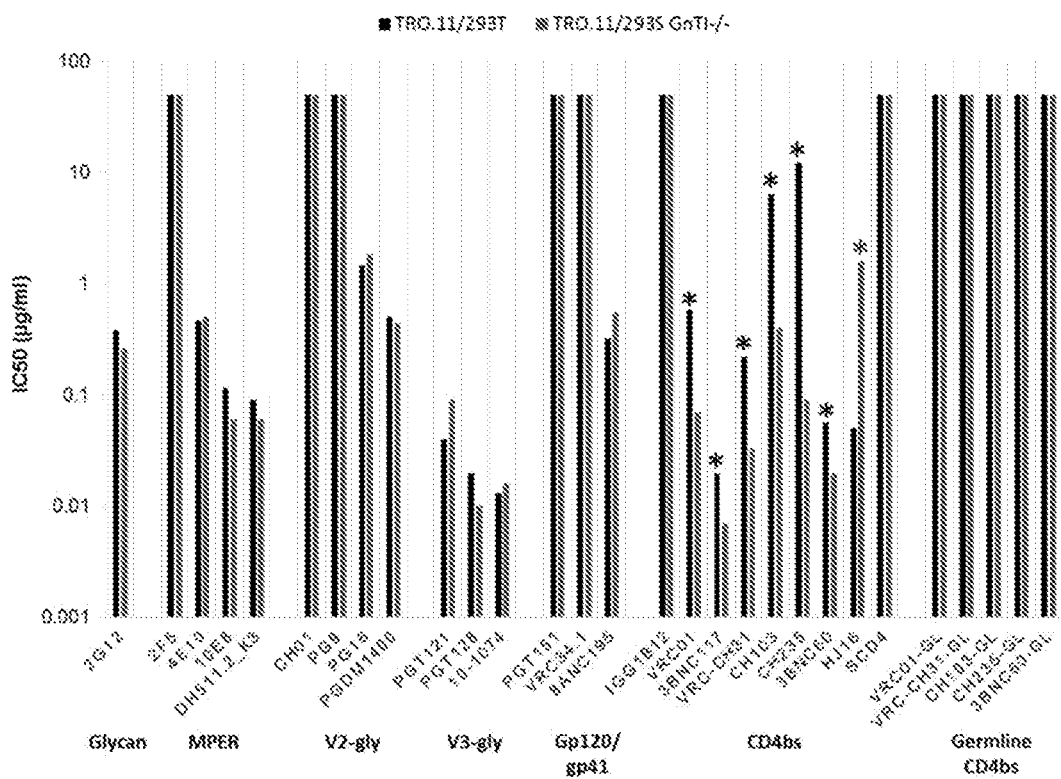

FIG. 83A-B shows the increased potency of CD4bs bNAbs against Man5-enriched (GnTI−) HIV-1. (A) Env-pseudotyped viruses CE1176 and WITO were produced in 293T cells (black bars) and 293S GnTI− cells (grey bars) and assessed for sensitivity to neutralization by three mature CD4bs bNAbs (VRC01, 3BNC117 and VRC-CH31) in TZM-bl cells. (B) Env-pseudotyped virus TRO.11 was produced in 293T and 293S GnTI− cells and assessed for sensitivity to neutralization in TZM-bl cells by a panel of mature bNAbs to multiple epitopes. Additional assays were performed with germline-reverted forms of CD4bs bNAbs. Black asterisks indicate CD4bs bNAb that were more potent against virus produced in 293S GnTI− cells. A red asterisk highlights a case where neutralization was less potent against the 293S GnTI− virus.

Figure 84A:
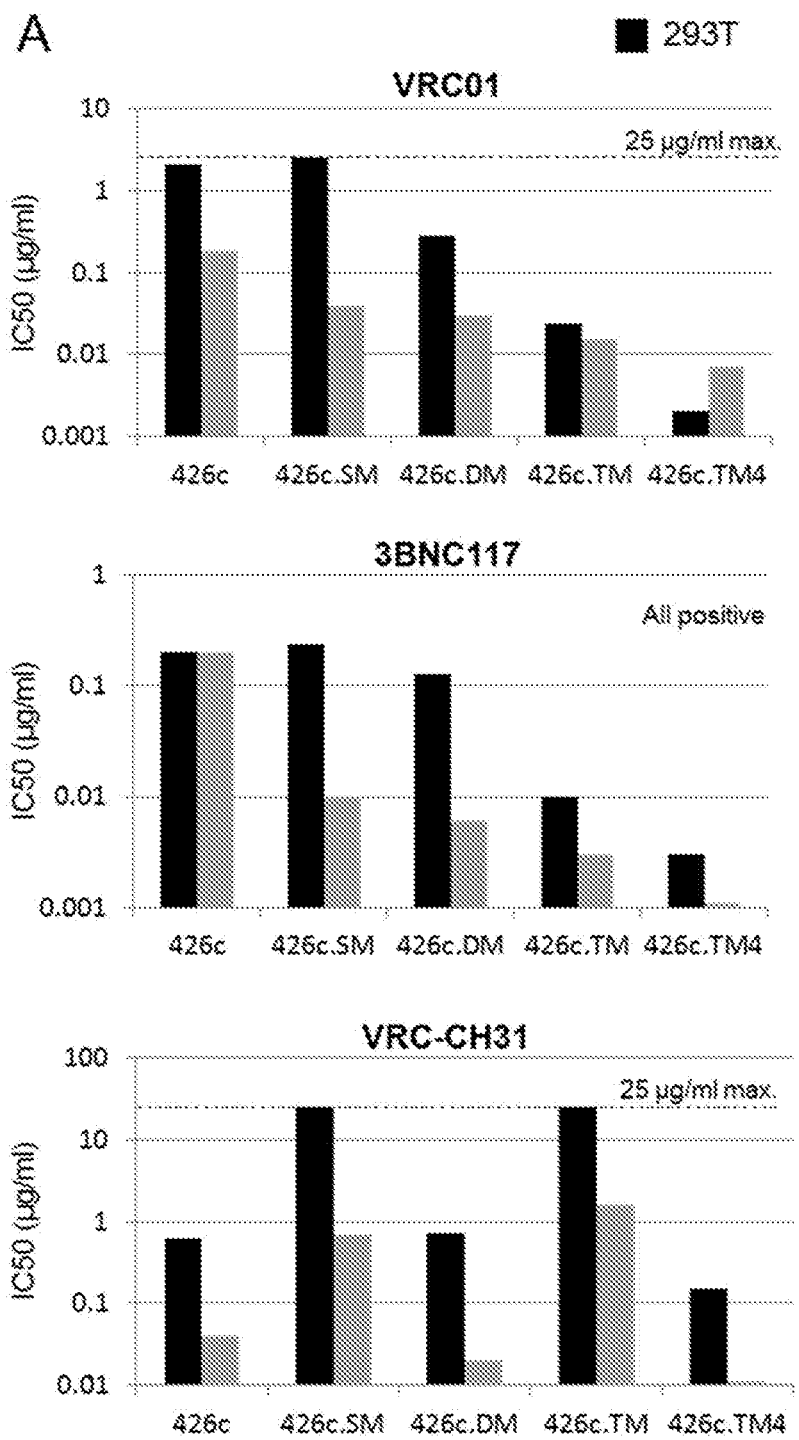
Figure 84A:
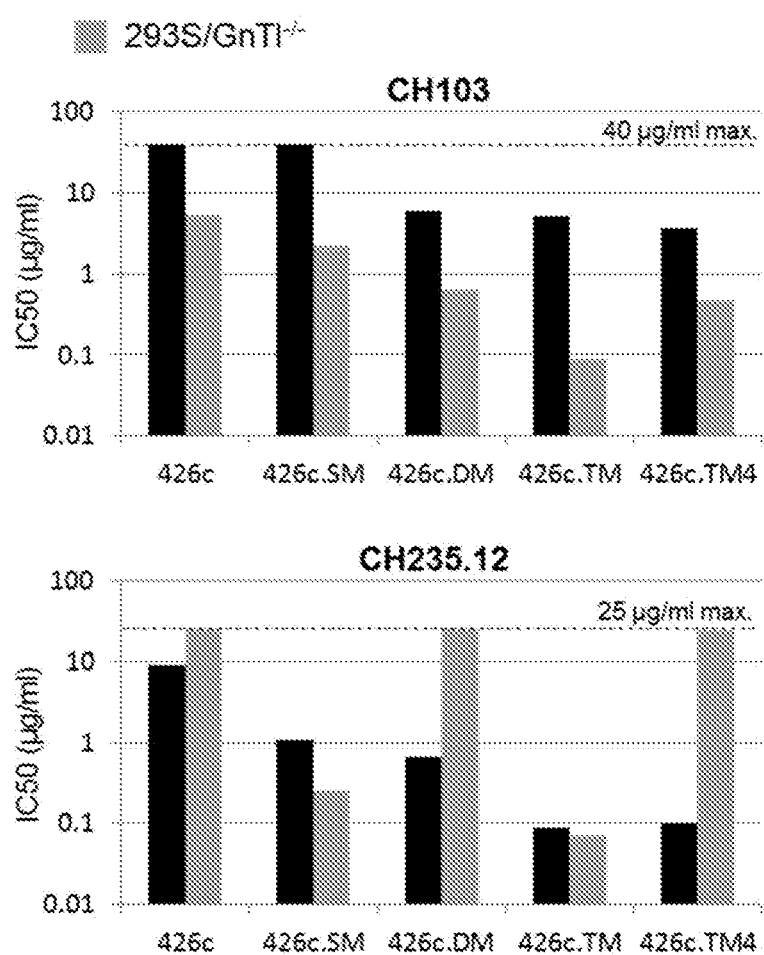
Figure 84B:
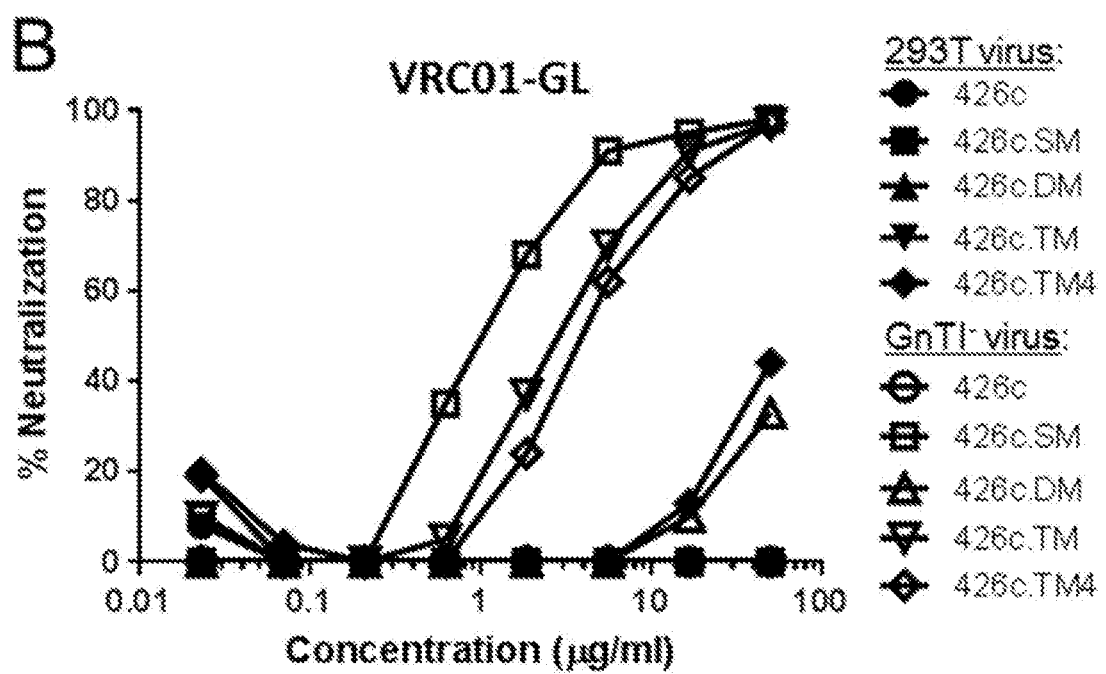

FIG. 84A-84B shows the complementarity of targeted glycan-deletion and Man5-enrichment for neutralization by germline-reverted VRC01. (A) Parental and glycan deletion mutants of 426c were produced as Env-pseudotyped viruses in 293T and 293S GnTI− cells and assayed for neutralization by five mature CD4bs bNAbs in TZM-bl cells. The 426c mutants were SM (N276D), DM (N460D.N463D), TM (N276D.N460D.N463D) and TM4 (S278R.G471S. N460D.N463D). Horizontal dotted lines indicate the highest concentration of bNAb tested. (B) Germline-reverted VRC01 was assayed against 426c, 426c.SM, 426c.DM, 426c.TM and 426c.TM4 Envs produced in 293T cells or 293S GnTI− cells. Neutralization was dependent on both Man5-enrichment and targeted glycan deletion. This germline-reverted VRC01 contains mature CDRH3 and J regions whose germlines cannot be inferred with existing sequence information.

Figure 85A:
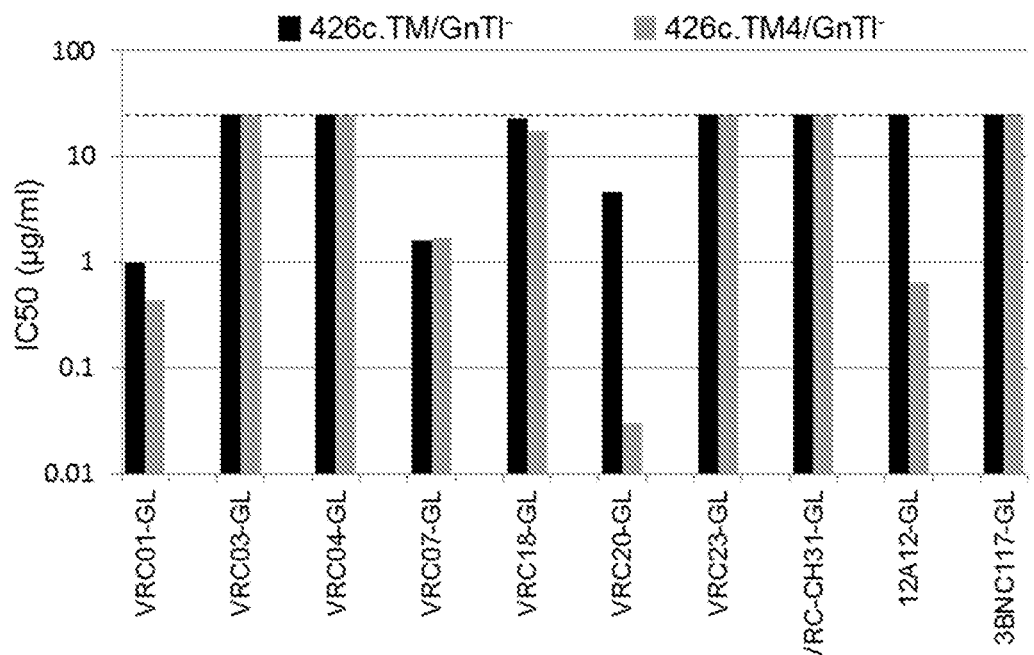
Figure 85B:
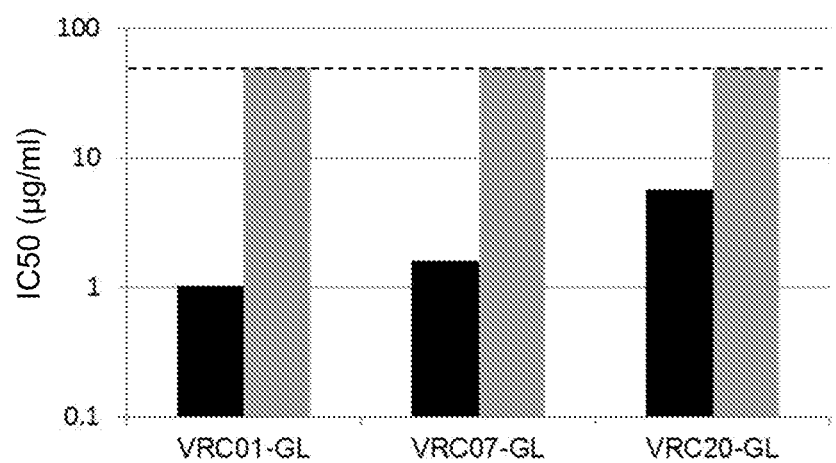

FIG. 85A-85B shows the detection and epitope mapping of neutralization by germline forms of VRC01-class bNAbs. (A) Germline reverted forms of the indicated bNAbs were assayed in TZM-bl cells against 426c.TM and 426c.TM4 Env-pseudotyped viruses produced in 293S GnTI− cells. The dotted line indicates the highest concentration of antibody tested (25 µg/ml). (B) Germline forms of VRC01, VRC07 and VRC20 were assayed in TZM-bl cells against Env 426c.TM (black bars) and Env 426c.TM.D279K (grey bars) produced in 293S GnTI− cells. The dotted line indicates the highest concentration of antibody tested (50 µg/ml).

Figure 86:
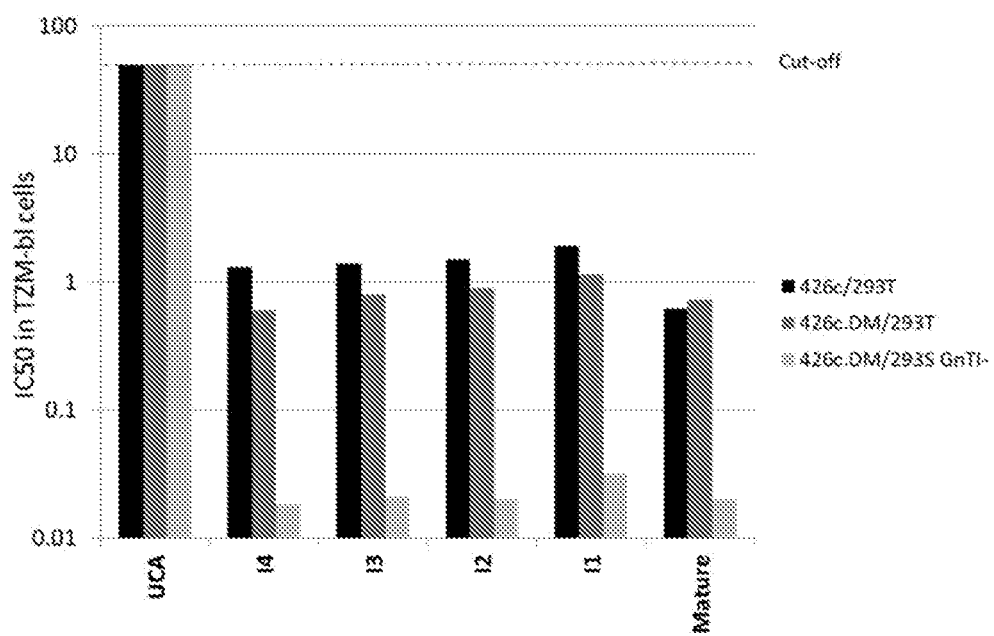

FIG. 86 shows the neutralization by intermediates of VRC-CH31. Inferred UCA, four late intermediates (I4 is least mature, I1 is most mature) and mature VRC-CH31 were assayed against 426c and 426c.DM Envs produced in 293T cells, and against Env 426c.DM produced in 293S GnTI− cells. GnTI− versions of 426c.SM and 426c.TM Envs were not assayed because they lack the N276 glycan that VRC01-CH31 requires. A horizontal dashed line is used to show the highest concentration tested (40 µg/ml for CH103, 25 µg/ml for VRC-CH31).

Figure 87A:
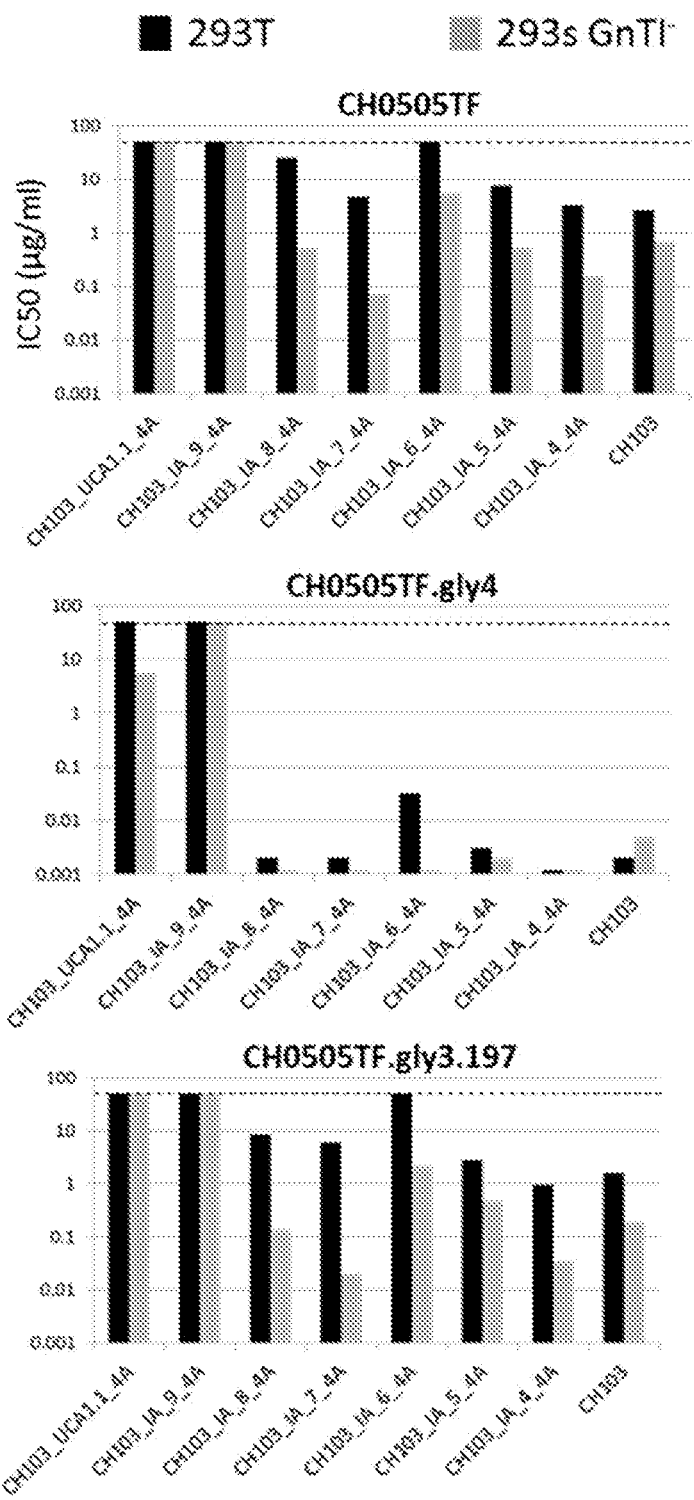
Figure 87A:
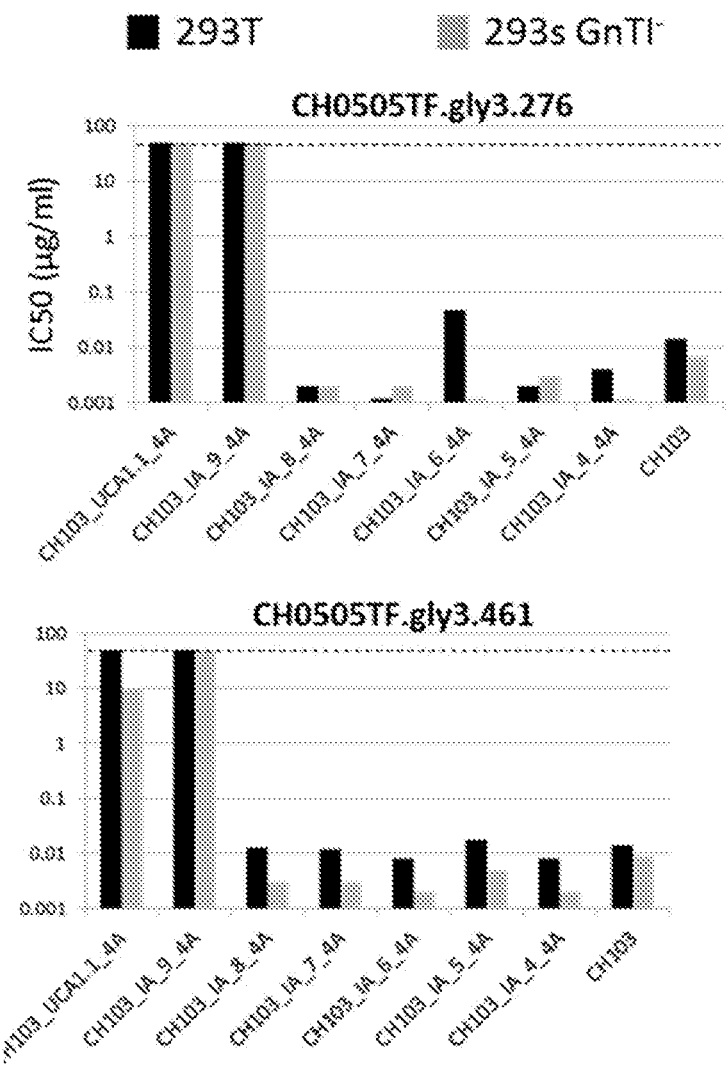
Figure 87B:
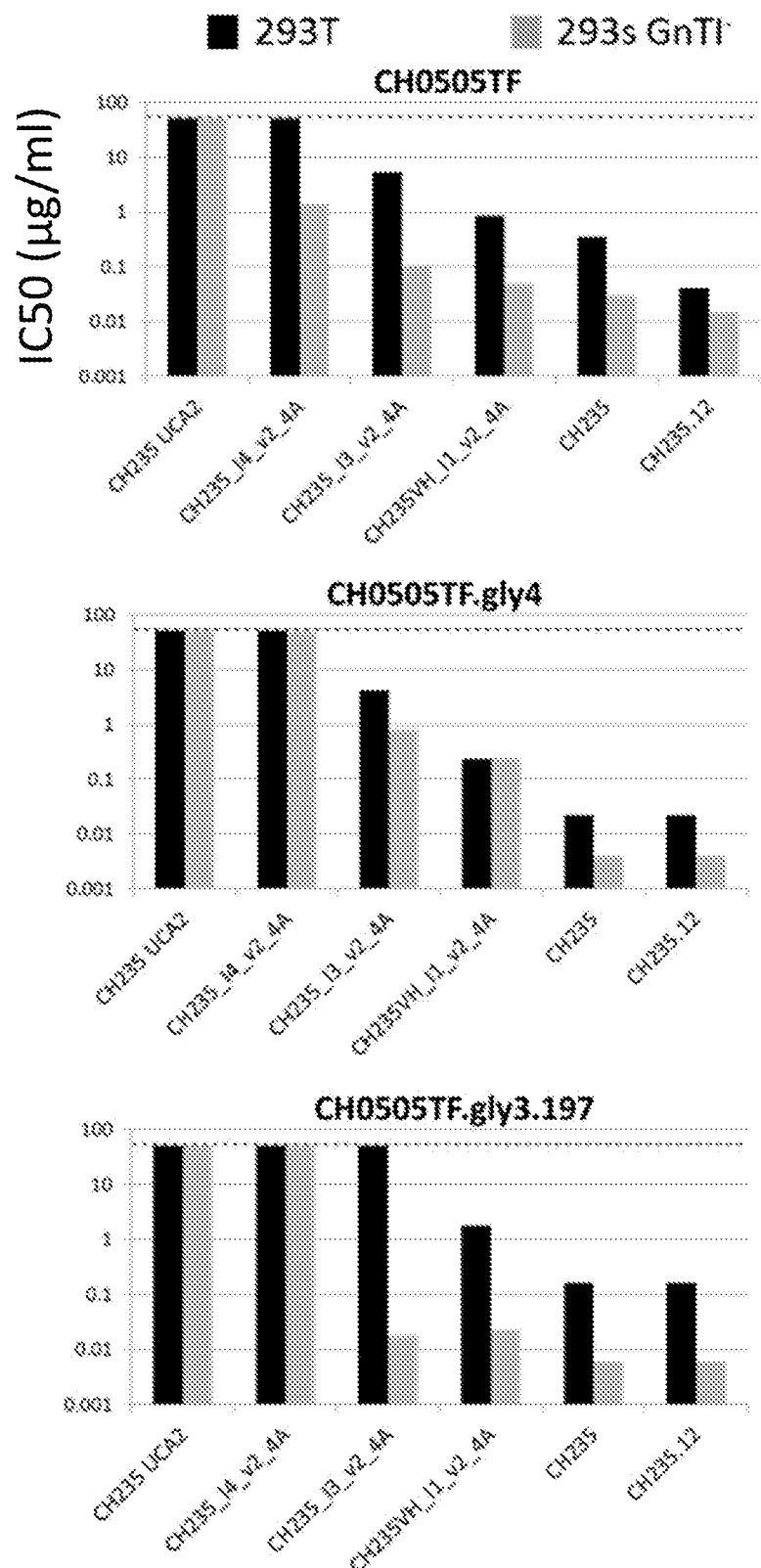
Figure 87B:
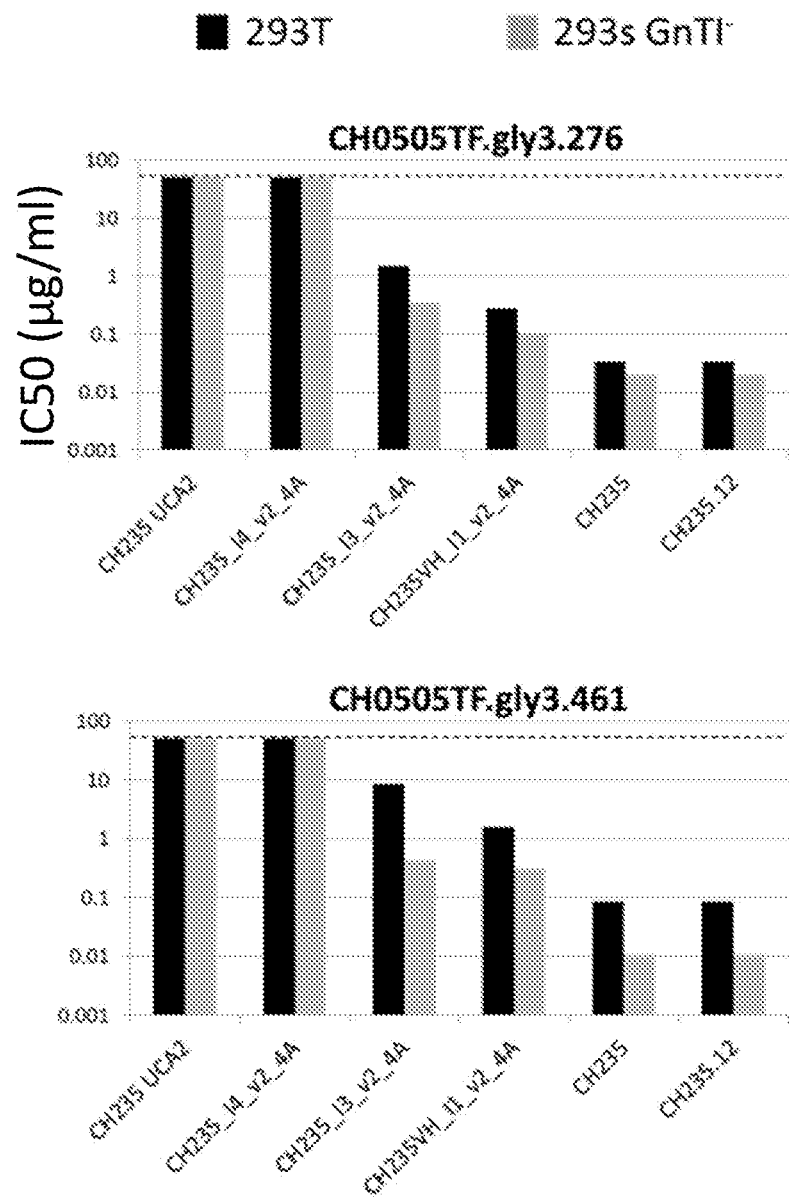

FIG. 87A-B shows the neutralization by intermediates of CH103 and CH235 in the context of targeted glycan-deleted autologous Envs produced in 293S GnTI− cells. Targeted glycan deleted variants of Env CH0505TF were produced in either 293T cells (back bars) or 293S GnTI− cells (grey bars) and assayed in TZM-bl cells. Assays were performed with UCAs, intermediates and mature forms of CH103 (A) and CH235 (B). The horizontal lines indicate the highest concentration of antibody tested (50 µg/ml).

Figure 88A:
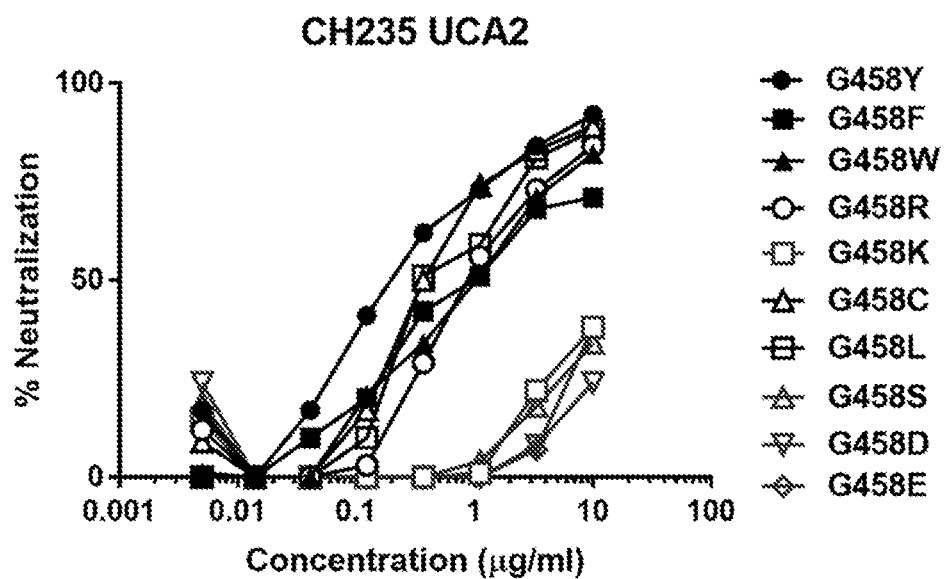
Figure 88B:
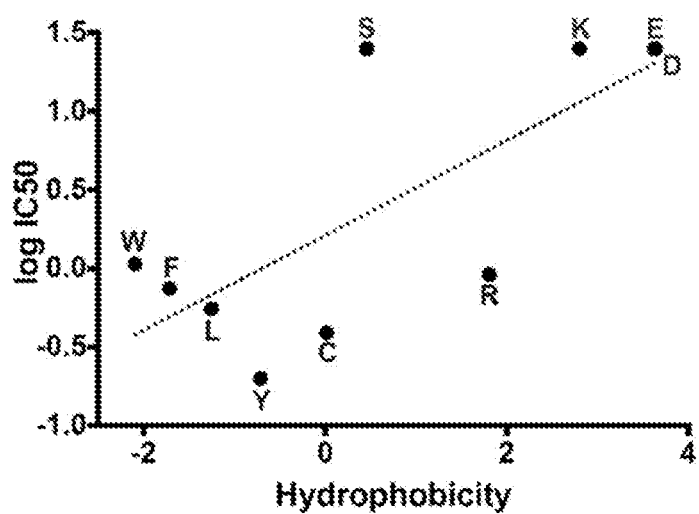
Figure 88C:
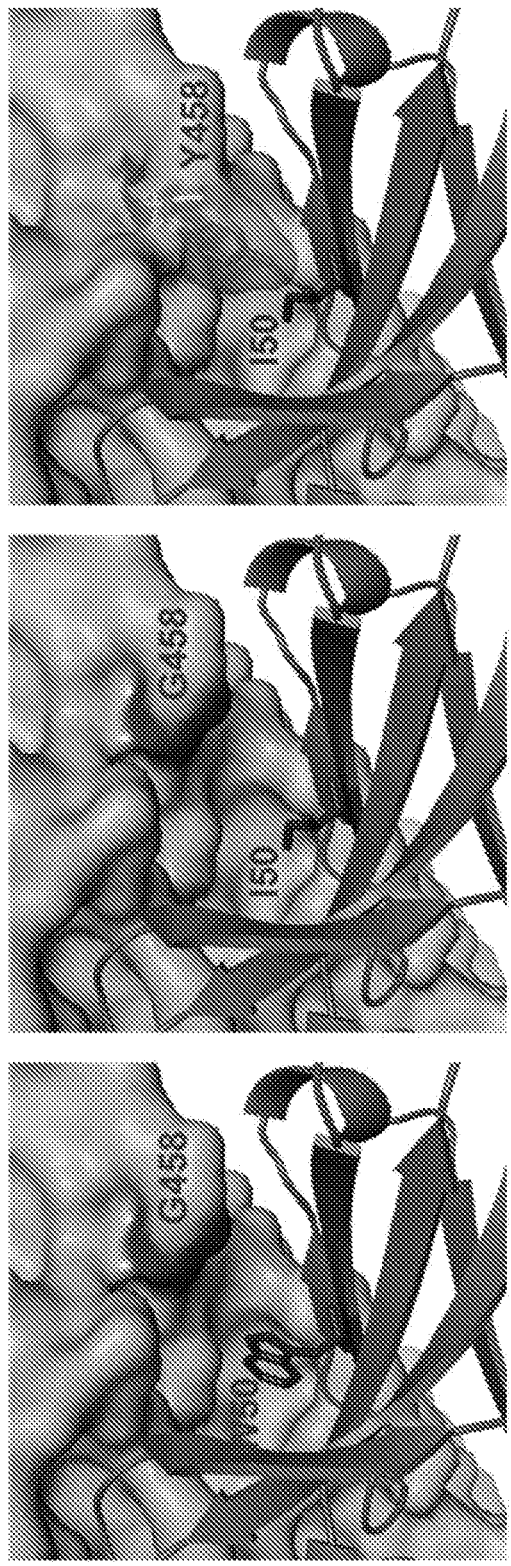

FIG. 88A-C shows the neutralization by germline-reverted CH235 requires both Man5 enrichment and mutation of G458 in gp120. (A) CH235 UCA2 was assayed for neutralizing activity against CH0505TF that was produced in GnTI− cells and contained different amino acid substitutions at position 458 of gp120. (B) Hydrophobicity of the amino acid substitutions at position 458 is correlated with CH235 UCA2 neutralization potency (Pearson's r=0.78). The hydrophobicity scale is oriented such that negative values correspond to more hydrophobic residues. The log IC50 scale is oriented such that negative values correspond to greater neutralization potency (neutralization achieved at lower antibody concentrations). (C) G458Y provides improved contacts with 150 in CDRH2 of CH235 UCA heavy chain. In these structures, the CD4-binding site on gp120 is shown as green space filled structure and the CDRH2 of CH235 is shown as blue ribbon structure. From the crystal structure of the wild-type gp120-CH235 complex (left panel), G458 (shown in magenta)) is small, and makes contact with the large aromatic rings of tryptophan (W50) of the DH235 CDRH2. In the DH235 UCA2, the residue at position 50 is isoleucine (I50), a much smaller amino acid. Structural modeling revealed that I50 does not reach into the cavity toward G458 (middle panel). When G458 is mutated to the larger tyrosine (Y458), structural modeling of this mutation showed the aromatic ring from gp120 can reach into the cavity to interact with the small isoleucine in CH235 UCA2 (right panel).

Figure 89:
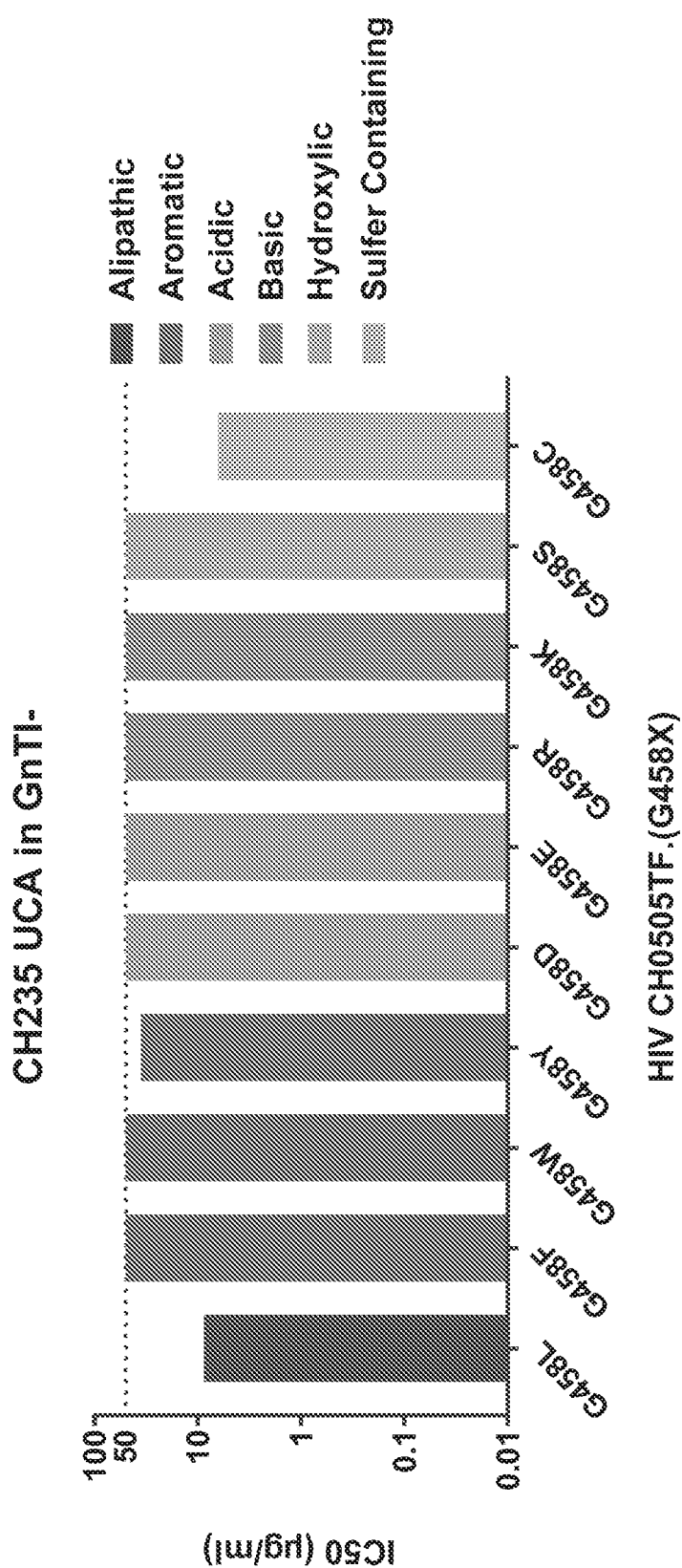

FIG. 89 shows impact of amino acids other than tyrosine (Y) at Env position 458.

Figure 90:
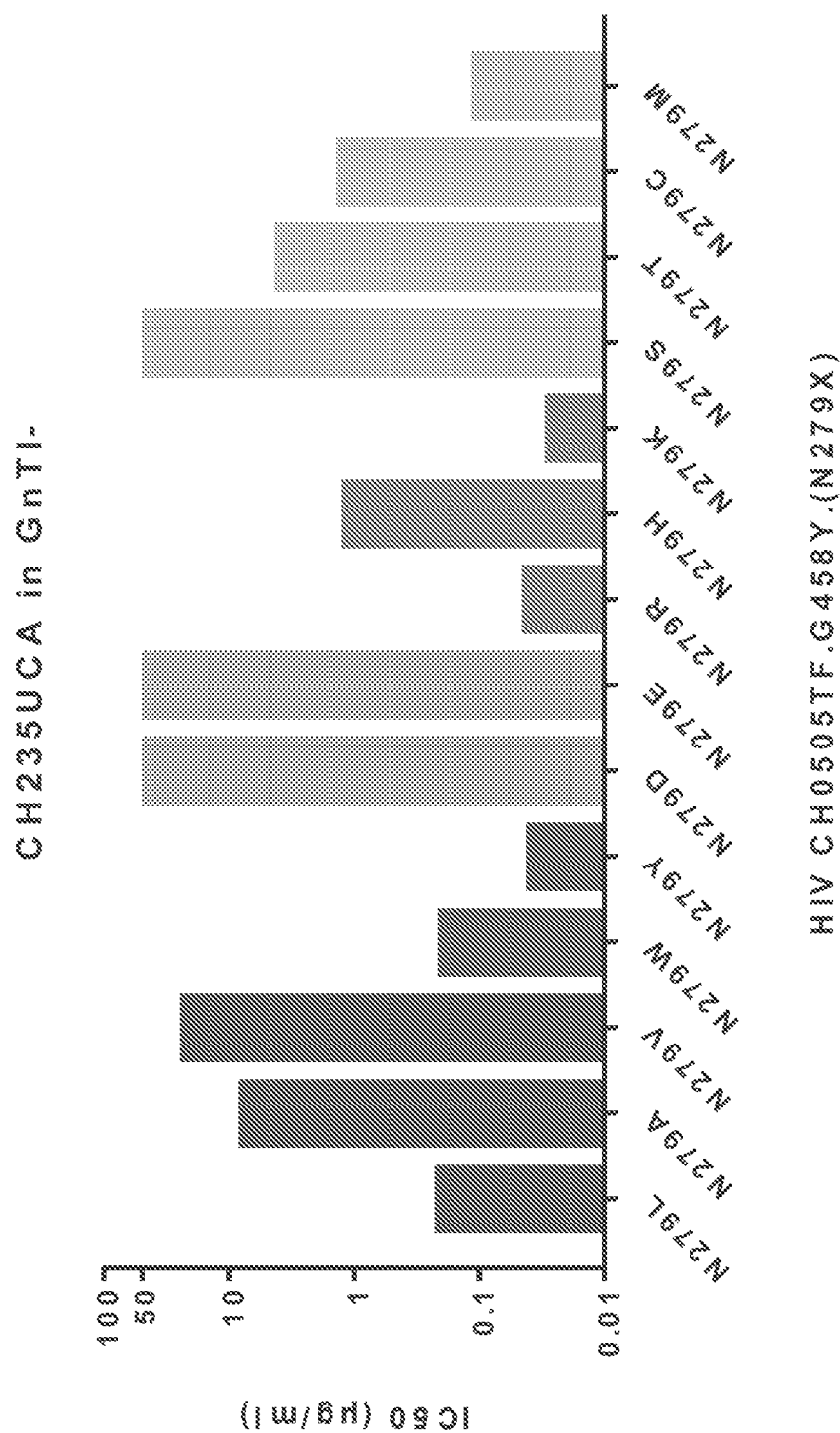

FIG. 90 shows impact of amino acids other than lysine (K) at Env position 279.

DETAILED DESCRIPTION OF THE INVENTION

The development of a safe, highly efficacious prophylactic HIV-1 vaccine is of paramount importance for the control and prevention of HIV-1 infection. A major goal of HIV-1 vaccine development is the induction of broadly neutralizing antibodies (bnAbs) (Immunol. Rev. 254: 225-244, 2013). BnAbs are protective in rhesus macaques against SHIV challenge, but as yet, are not induced by current vaccines.

The ability to stimulate germline B cells that give rise to broadly neutralizing antibodies (bNAbs) is a major goal for HIV-1 vaccine development. bNAbs that target the CD4-binding site (CD4bs) and exhibit extraordinary potency and breadth of neutralization are particularly attractive to elicit with vaccines. Glycans that border the CD4bs and impede the binding of germline-reverted forms of CD4bs bNAbs are potential barriers to naïve B-cell receptor engagement. In some aspects, pseudovirus neutralization was used as a means to identify Env modifications that permit native Env trimer binding to germline reverted CD4bs bNAb CH235.12 (VH1-46). Two mutations (N279K.G458Y), when combined with Man5-enrichment of N-linked glycans that are otherwise processed into complex glycans, rendered autologous CH0505TF Env highly sensitive to neutralization by CH235.12 UCA. These findings suggest a vaccine strategy to initiate and mature the CH235.12 lineage.

In some embodiments, site-directed mutagenesis was used to create mutants of autologous CH0505TF Env. Mutants were produced in 293T/17 and 293S/GnTI-cells lacking the enzyme N-acetylglucosaminyltransferase (GnTI-) to enrich for Man5 glycoforms. Naturally-glycosylated and Man5-enriched forms of parental and mutant Envs were tested for neutralization by the unmutated common ancestor (UCA), intermediates, and mature forms of CH235.12. Various trimers comprising these mutations were tested for UCA binding.

In some aspects, the paradigm of B cell lineage immunogen design (Nature Biotech. 30: 423, 2012) in which the induction of bnAb lineages is recreated is also used to identify other immunogens for use in the methods of the invention. It was recently demonstrated the power of mapping the co-evolution of bnAbs and founder virus for elucidating the Env evolution pathways that lead to bnAb induction (Nature 496: 469, 2013). From this type of work has come the hypothesis that bnAb induction will require a selection of antigens to recreate the "swarms" of sequentially evolved viruses that occur in the setting of bnAb generation in vivo in HIV infection (Nature 496: 469, 2013).

A critical question is why the CH505 immunogens are better than other immunogens. This rationale comes from three recent observations. First, a series of immunizations of single putatively "optimized" or "native" trimers when used as an immunogen have not induced bnAbs as single immunogens. Second, in all the chronically infected individuals who do develop bnAbs, they develop them in plasma after ~2 years. When these individuals have been studied at the time soon after transmission, they do not make bnAbs immediately. Third, now that individual's virus and bnAb co-evolution has been mapped from the time of transmission to the development of bnAbs, the identification of the specific Envs that lead to bnAb development have been identified-thus taking the guess work out of envelope choice.

Two other considerations are important. The first is that for the CH103 bnAb CD4 binding site lineage, the VH4-59 and Vλ3-1 genes are common as are the VDJ, VJ recombinations of the lineage (Liao, Nature 496: 469, 2013). In addition, the bnAb sites are so unusual, we are finding that the same VH and VL usage is recurring in multiple individuals. Thus, we can expect the CH505 Envs to induce CD4 binding site antibodies in many different individuals.

Regarding the choice of gp120 vs. gp160, for the genetic immunization we would normally not even consider not using gp160. However, in acute infection, gp41 non-neutralizing antibodies are dominant and overwhelm gp120 responses (Tomaras, G et al. J. Virol. 82: 12449, 2008; Liao, H X et al. JEM 208: 2237, 2011). Recently we have found that the HVTN 505 DNA prime, rAd5 vaccine trial that utilized gp140 as an immunogen, also had the dominant response of non-neutralizing gp41 antibodies. Thus, we will evaluate early on the use of gp160 vs gp120 for gp41 dominance.

In certain aspects the invention provides a strategy for induction of bnAbs is to select and develop immunogens and combinations designed to recreate the antigenic evolution of Envs that occur when bnAbs do develop in the context of infection.

That broadly neutralizing antibodies (bnAbs) occur in nearly all sera from chronically infected HIV-1 subjects suggests anyone can develop some bnAb response if exposed to immunogens via vaccination. Working back from mature bnAbs through intermediates enabled understanding their development from the unmutated ancestor, and showed that antigenic diversity preceded the development of population breadth. See Liao et al. (2013) Nature 496, 469-476. In this study, an individual "CH505" was followed from HIV-1 transmission to development of broadly neutralizing antibodies. This individual developed antibodies targeted to CD4 binding site on gp120. In this individual the virus was sequenced over time, and broadly neutralizing antibody clonal lineage ("CH103") was isolated by antigen-specific B cell sorts, memory B cell culture, and amplified by VH/VL next generation pyrosequencing. The CH103 lineage began by binding the T/F virus, autologous neutralization evolved through somatic mutation and affinity maturation, escape from neutralization drove rapid (clearly by 20 weeks) accumulation of variation in the epitope, antibody breadth followed this viral diversification.

Further analysis of envelopes and antibodies from the CH505 individual indicated that a non-CH103 Lineage (DH235=CH235) participates in driving CH103-BnAb induction. See Gao et al. (2014) Cell 158:481-491. For example, V1 loop, V5 loop and CD4 binding site loop mutations escape from CH103 and are driven by CH103 lineage. Loop D mutations enhanced neutralization by CH103 lineage and are driven by another lineage. Transmitted/founder Env, or another early envelope for example W004.26, triggers naïve B cell with CH103 Unmutated Common Ancestor (UCA) which develop in to intermediate antibodies. Transmitted/founder Env, or another early envelope for example W004.26, also triggers non-CH103 autologous neutralizing Abs that drive loop D mutations in Env that have enhanced binding to intermediate and mature CH103 antibodies and drive remainder of the lineage. In certain embodiments, the inventive composition and methods also comprise loop D mutant envelopes (e.g. but not limited to M10, M11, M19, M20, M21, M5, M6, M7, M8, M9) as immunogens. In certain embodiments, the D-loop mutants are included in an inventive composition used to induce an immune response in a subject. In certain embodiments, the D-loop mutants are included in a composition used as a prime.

The invention provides various methods to choose a subset of viral variants, including but not limited to envelopes, to investigate the role of antigenic diversity in serial samples. In other aspects, the invention provides compositions comprising viral variants, for example but not limited to envelopes, selected based on various criteria as described herein to be used as immunogens. In some embodiments, the immunogens are selected based on the envelope binding to the UCA, and/or intermediate antibodies. In some embodiments the immunogens are selected based on their chronological appearance and/or sequence diversity during infection.

In other aspects, the invention provides immunization strategies using the selections of immunogens to induce cross-reactive neutralizing antibodies. In certain aspects, the immunization strategies as described herein are referred to as "swarm" immunizations to reflect that multiple envelopes are used to induce immune responses. The multiple envelopes in a swarm could be combined in various immunization protocols of priming and boosting. Immune responses, including B cell and T cell responses, could be measured by any suitable assay and criteria, such as but non limited plasma neutralization, plasma binding to vaccine and/or heterologous envelopes and/or viruses could be measured.

In certain embodiments the invention provides that sites losing the ancestral, transmitted-founder (T/F) state are most likely under positive selection. From acute, homogenous infections with 3-5 years of follow-up, identified herein are sites of interest among plasma single genome analysis (SGA) Envs by comparing the proportion of sequences per time-point in the T/F state with a threshold, typically 5%. Sites with T/F frequencies below threshold are putative escapes. We then selected clones with representative escape mutations. Where more information was available, such as tree-corrected neutralization signatures and antibody contacts from co-crystal structure, additional sites of interest were considered.

Co-evolution of a broadly neutralizing HIV-1 antibody (CH103) and founder virus was previously reported in African donor (CH505). See Liao et al. (2013) Nature 496, 469-476. In CH505, which had an early antibody that bound autologous T/F virus, we studied 398 envs from 14 time-points over three years (median per sample: 25, range: 18-53). We found 36 sites with T/F frequencies under 20% in any sample. Neutralization and structure data identified 28 and 22 interesting sites, respectively. Together, six gp41 and 53 gp120 sites were identified, plus six V1 or V5 insertions not in HXB2.

The invention provides an approach to select reagents for neutralization assays and subsequently investigate affinity maturation, autologous neutralization, and the transition to heterologous neutralization and breadth. Given the sustained coevolution of immunity and escape this antigen selection based on antibody and antigen coevolution has specific implications for selection of immunogens for vaccine design.

In one embodiment, five envelopes were selected that represent envelope antigenic diversity. In another embodiment, six envelopes were selected that represent envelope antigenic diversity. In another embodiment, ten envelopes were selected that represent envelope antigenic diversity. These sets of envelopes represent antigenic diversity by deliberate inclusion of polymorphisms that result from immune selection by neutralizing antibodies. These selections represent various levels of antigenic diversity in the HIV-1 envelope. In some embodiments the selections are based on the genetic diversity of longitudinally sampled SGA envelopes. In some embodiments the selections are based on antigenic and or neutralization diversity. In some embodiments the selections are based on the genetic diversity of longitudinally sampled SGA envelopes, and correlated with other factors such as antigenic/neutralization diversity, and antibody coevolution.

Sequences/Clones

Described herein are nucleic and amino acids sequences of HIV-1 envelopes. The sequences for use as immunogens are in any suitable form. In certain embodiments, the described HIV-1 envelope sequences are gp160s. In certain embodiments, the described HIV-1 envelope sequences are gp120s. Other sequences, for example but not limited to stable SOSIP trimer designs, gp145s, gp140s, both cleaved and uncleaved, gp140 Envs with the deletion of the cleavage (C) site, fusion (F) and immunodominant (I) region in gp41—named as gp140ΔCFI (gp140CFI), gp140 Envs with the deletion of only the cleavage (C) site and fusion (F) domain—named as gp140ΔCF (gp140CF), gp140 Envs with the deletion of only the cleavage (C)—named gp140ΔC (gp140C) (See e.g. Liao et al. Virology 2006, 353, 268-282), gp150s, gp41s, which are readily derived from the nucleic acid and amino acid gp160 sequences. In certain embodiments the nucleic acid sequences are codon optimized for optimal expression in a host cell, for example a mammalian cell, a rBCG cell or any other suitable expression system.

An HIV-1 envelope has various structurally defined fragments/forms: gp160; gp140—including cleaved gp140 and uncleaved gp140 (gp140C), gp140CF, or gp140CFL gp120 and gp41. A skilled artisan appreciates that these fragments/forms are defined not necessarily by their crystal structure, but by their design and bounds within the full length of the gp160 envelope. While the specific consecutive amino acid sequences of envelopes from different strains are different, the bounds and design of these forms are well known and characterized in the art.

For example, it is well known in the art that during its transport to the cell surface, the gp160 polypeptide is processed and proteolytically cleaved to gp120 and gp41 proteins. Cleavages of gp160 to gp120 and gp41 occurs at a conserved cleavage site "REKR." (SEQ ID NO: 1) See Chakrabarti et al. Journal of Virology vol. 76, pp. 5357-5368 (2002) see for example FIG. 1, and Second paragraph in the Introduction on p. 5357; Binley et al. Journal of Virology vol. 76, pp. 2606-2616 (2002) for example at Abstract; Gao et al. Journal of Virology vol. 79, pp. 1154-1163 (2005); Liao et al. Virology vol. 353(2): 268-282 (2006).

The role of the furin cleavage site was well understood both in terms of improving cleave efficiency, see Binley et al. supra, and eliminating cleavage, see Bosch and Pawlita, Virology 64 (5):2337-2344 (1990); Guo et al. Virology 174: 217-224 (1990); McCune et al. Cell 53:55-67 (1988); Liao et al. J Virol. April; 87(8):4185-201 (2013).

Likewise, the design of gp140 envelope forms is also well known in the art, along with the various specific changes which give rise to the gp140C (uncleaved envelope), gp140CF and gp140CFI forms. Envelope gp140 forms are designed by introducing a stop codon within the gp41 sequence. See Chakrabarti et al. at FIG. 1.

Envelope gp140C refers to a gp140 HIV-1 envelope design with a functional deletion of the cleavage (C) site, so that the gp140 envelope is not cleaved at the furin cleavage site. The specification describes cleaved and uncleaved forms, and various furin cleavage site modifications that prevent envelope cleavage are known in the art. In some embodiments of the gp140C form, two of the R residues in and near the furin cleavage site are changed to E, e.g., RRVVEREKR (SEQ ID NO: 2) is changed to ERVVEREKE (SEQ ID NO: 3), and is one example of an uncleaved gp140 form. Another example is the gp140C form which has the REKR site (SEQ ID NO: 1) changed to SEKS (SEQ ID NO: 4). See supra for references.

Envelope gp140CF refers to a gp140 HIV-1 envelope design with a deletion of the cleavage (C) site and fusion (F) region. Envelope gp140CFI refers to a gp140 HIV-1 envelope design with a deletion of the cleavage (C) site, fusion (F) and immunodominant (I) region in gp41. See Chakrabarti et al. Journal of Virology vol. 76, pp. 5357-5368 (2002) see for example FIG. 1, and Second paragraph in the Introduction on p. 5357; Binley et al. Journal of Virology vol. 76, pp. 2606-2616 (2002) for example at Abstract; Gao et al. Journal of Virology vol. 79, pp. 1154-1163 (2005); Liao et al. Virology vol. 353(2): 268-282 (2006).

In certain embodiments, the envelope design in accordance with the present invention involves deletion of residues (e.g., 5-11, 5, 6, 7, 8, 9, 10, or 11 amino acids) at the N-terminus. For delta N-terminal design, amino acid residues ranging from 4 residues or even fewer to 14 residues or even more are deleted. These residues are between the maturation (signal peptide, usually ending with CX, X can be any amino acid) and "VPVXXXX . . . ". In case of CH505 T/F Env as an example, 8 amino acids (italicized and underlined in the below sequence) were deleted: MRVMGIQRNYPQWWIWSMLGFWMLMICNG MWVTVYYGVPVWKEAKTTLFCASDA KAYEKEVHNVWATHACVPTDPNPQE . . . (rest of envelope sequence is indicated as " . . . ") (SEQ ID NO: 5). In other embodiments, the delta N-design described for CH505 T/F envelope can be used to make delta N-designs of other CH505 envelopes. In certain embodiments, the invention relates generally to an immunogen, gp160, gp120 or gp140, without an N-terminal Herpes Simplex gD tag substituted for amino acids of the N-terminus of gp120, with an HIV leader sequence (or other leader sequence), and without the original about 4 to about 25, for example 4, 5, 6, 7, 8, 9, 10, 11, 12, 13, 14, 15, 16, 17, 18, 19, 20, 21, 22, 23, 24, 25 amino acids of the N-terminus of the envelope (e.g. gp120). See WO2013/006688, e.g. at pages 10-12, the contents of which publication is hereby incorporated by reference in its entirety.

The general strategy of deletion of N-terminal amino acids of envelopes results in proteins, for example gp120s, expressed in mammalian cells that are primarily monomeric, as opposed to dimeric, and, therefore, solves the production and scalability problem of commercial gp120 Env vaccine production. In other embodiments, the amino acid deletions at the N-terminus result in increased immunogenicity of the envelopes.

In certain embodiments, the invention provides envelope sequences, amino acid sequences and the corresponding nucleic acids, and in which the V3 loop is substituted with the following V3 loop sequence TRPNNNTRKSIRIGPGQTFY ATGDIIGNIRQAH (SEQ ID NO: 6). This substitution of the V3 loop reduced product cleavage and improves protein yield during recombinant protein production in CHO cells.

In certain embodiments, the CH505 envelopes will have added certain amino acids to enhance binding of various broad neutralizing antibodies. Such modifications could include but not limited to, mutations at W680G or modification of glycan sites for enhanced neutralization.

In certain aspects, the invention provides composition and methods which use a selection of sequential CH505 Envs, as gp120s, gp 140s cleaved and uncleaved, gp145s, gp150s and gp160s, stabilized and/or multimerized trimers, as proteins, DNAs, RNAs, or any combination thereof, administered as primes and boosts to elicit immune response. Sequential CH505 Envs as proteins would be co-administered with nucleic acid vectors containing Envs to amplify antibody induction. In certain embodiments, the compositions and methods include any immunogenic HIV-1 sequences to give the best coverage for T cell help and cytotoxic T cell induction. In certain embodiments, the compositions and methods include mosaic and/or consensus HIV-1 genes to give the best coverage for T cell help and cytotoxic T cell induction. In certain embodiments, the compositions and methods include mosaic group M and/or consensus genes to give the best coverage for T cell help and cytotoxic T cell induction. In some embodiments, the mosaic genes are any suitable gene from the HIV-1 genome. In some embodiments, the mosaic genes are Env genes, Gag genes, Pol genes, Nef genes, or any combination thereof. See e.g. U.S. Pat. No. 7,951,377. In some embodiments the mosaic genes are bivalent mosaics. In some embodiments the mosaic genes are trivalent. In some embodiments, the mosaic genes are administered in a suitable vector with each immunization with Env gene inserts in a suitable vector and/or as a protein. In some embodiments, the mosaic genes, for example as bivalent mosaic Gag group M consensus genes, are administered in a suitable vector, for example but not limited to HSV2, would be administered with each immunization with Env gene inserts in a suitable vector, for example but not limited to HSV-2.

In certain aspects the invention provides compositions and methods of Env genetic immunization either alone or with Env proteins to recreate the swarms of evolved viruses that have led to bnAb induction. Nucleotide-based vaccines offer a flexible vector format to immunize against virtually any protein antigen. Currently, two types of genetic vaccination are available for testing—DNAs and mRNAs.

In certain aspects the invention contemplates using immunogenic compositions wherein immunogens are delivered as DNA. See Graham B S, Enama M E, Nason M C, Gordon I J, Peel S A, et al. (2013) DNA Vaccine Delivered by a Needle-Free Injection Device Improves Potency of Priming for Antibody and CD8+ T-Cell Responses after rAd5 Boost in a Randomized Clinical Trial. PLoS ONE 8(4): e59340, page 9. Various technologies for delivery of nucleic acids, as DNA and/or RNA, so as to elicit immune response, both T-cell and humoral responses, are known in the art and are under developments. In certain embodiments, DNA can be delivered as naked DNA. In certain embodiments, DNA is formulated for delivery by a gene gun. In certain embodiments, DNA is administered by electroporation, or by a needle-free injection technologies, for example but not limited to Biojector® device. In certain embodiments, the DNA is inserted in vectors. The DNA is delivered using a suitable vector for expression in mammalian cells. In certain embodiments the nucleic acids encoding the envelopes are optimized for expression. In certain embodiments DNA is optimized, e.g. codon optimized, for expression. In certain embodiments the nucleic acids are optimized for expression in vectors and/or in mammalian cells. In non-limiting embodiments these are bacterially derived vectors, adenovirus based vectors, rAdenovirus (e.g. Barouch D H, et al. Nature Med. 16: 319-23, 2010), recombinant mycobacteria (e.g. rBCG or M smegmatis) (Yu, J S et al. Clinical Vaccine Immunol. 14: 886-093, 2007; ibid 13: 1204-11, 2006), and recombinant vaccinia type of vectors (Santra S. Nature Med. 16: 324-8, 2010), for example but not limited to ALVAC, replicating (Kibler K V et al., PLoS One 6: e25674, 2011 Nov. 9.) and non-replicating (Perreau M et al. J. virology 85: 9854-62, 2011) NYVAC, modified vaccinia Ankara (MVA)), adeno-associated virus, Venezuelan equine encephalitis (VEE) replicons, Herpes Simplex Virus vectors, and other suitable vectors.

In certain aspects the invention contemplates using immunogenic compositions wherein immunogens are delivered as DNA or RNA in suitable formulations. Various technologies which contemplate using DNA or RNA, or may use complexes of nucleic acid molecules and other entities to be used in immunization. In certain embodiments, DNA or RNA is administered as nanoparticles consisting of low dose antigen-encoding DNA formulated with a block copolymer (amphiphilic block copolymer 704). See Cany et al., Journal of Hepatology 2011 vol. 54 j 115-121; Arnaoty et al., Chapter 17 in Yves Bigot (ed.), Mobile Genetic Elements: Protocols and Genomic Applications, Methods in Molecular Biology, vol. 859, pp 293-305 (2012); Arnaoty et al. (2013) Mol Genet Genomics. 2013 August; 288(7-8):347-63. Nanocarrier technologies called Nanotaxi® for immunogenic macromolecules (DNA, RNA, Protein) delivery are under development. See for example technologies developed by incellart.

In certain aspects the invention contemplates using immunogenic compositions wherein immunogens are delivered as recombinant proteins. Various methods for production and purification of recombinant proteins, including trimers such as but not limited to SOSIP based trimers, suitable for use in immunization are known in the art. In certain embodiments recombinant proteins are produced in CHO cells.

The immunogenic envelopes can also be administered as a protein boost in combination with a variety of nucleic acid envelope primes (e.g., HIV-1 Envs delivered as DNA expressed in viral or bacterial vectors).

Dosing of proteins and nucleic acids can be readily determined by a skilled artisan. A single dose of nucleic acid can range from a few nanograms (ng) to a few micrograms (μg) or milligram of a single immunogenic nucleic acid. Recombinant protein dose can range from a few μg micrograms to a few hundred micrograms, or milligrams of a single immunogenic polypeptide.

Administration: The compositions can be formulated with appropriate carriers using known techniques to yield compositions suitable for various routes of administration. In certain embodiments the compositions are delivered via intramascular (IM), via subcutaneous, via intravenous, via nasal, via mucosal routes, or any other suitable route of immunization.

The compositions can be formulated with appropriate carriers and adjuvants using techniques to yield compositions suitable for immunization. The compositions can include an adjuvant, such as, for example but not limited to, alum, poly IC, MF-59 or other squalene-based adjuvant, ASOIB, or other liposomal based adjuvant suitable for protein or nucleic acid immunization. In certain embodiments, the adjuvant is GSK AS01E adjuvant containing MPL and QS21. This adjuvant has been shown by GSK to be as potent as the similar adjuvant AS01B but to be less reactogenic using HBsAg as vaccine antigen [Leroux-Roels et al., IABS Conference, April 2013]. In certain embodiments, TLR agonists are used as adjuvants. In other embodiment, adjuvants which break immune tolerance are included in the immunogenic compositions.

In certain embodiments, the compositions and methods comprise any suitable agent or immune modulation which could modulate mechanisms of host immune tolerance and release of the induced antibodies. In non-limiting embodiments modulation includes PD-1 blockade; T regulatory cell depletion; CD40L hyperstimulation; soluble antigen administration, wherein the soluble antigen is designed such that the soluble agent eliminates B cells targeting dominant epitopes, or a combination thereof. In certain embodiments, an immunomodulatory agent is administered in at time and in an amount sufficient for transient modulation of the subject's immune response so as to induce an immune response which comprises broad neutralizing antibodies against HIV-1 envelope. Non-limiting examples of such agents is any one of the agents described herein: e.g. chloroquine (CQ), PTP1B Inhibitor—CAS 765317-72-4—Calbiochem or MSI 1436 clodronate or any other bisphosphonate; a Foxo1 inhibitor, e.g. 344355|Foxo1 Inhibitor, AS1842856—Calbiochem; Gleevac, anti-CD25 antibody, anti-CCR4 Ab, an agent which binds to a B cell receptor for a dominant HIV-1 envelope epitope, or any combination thereof. In non-limiting embodiments, the modulation includes administering an anti-CTLA4 antibody. Non-limiting examples are ipilimumab and tremelimumab. In certain embodiments, the methods comprise administering a second immunomodulatory agent, wherein the second and first immunomodulatory agents are different.

There are various host mechanisms that control bNAbs. For example highly somatically mutated antibodies become autoreactive and/or less fit (Immunity 8: 751, 1998; PloS Comp. Biol. 6 e1000800, 2010; J. Thoret. Biol. 164:37, 1993); Polyreactive/autoreactive naïve B cell receptors (unmutated common ancestors of clonal lineages) can lead to deletion of Ab precursors (Nature 373: 252, 1995; PNAS 107: 181, 2010; J. Immunol. 187: 3785, 2011); Abs with long HCDR3 can be limited by tolerance deletion (JI 162: 6060, 1999; JCI 108: 879, 2001). BnAb knock-in mouse models are providing insights into the various mechanisms of tolerance control of MPER BnAb induction (deletion, anergy, receptor editing). Other variations of tolerance control likely will be operative in limiting BnAbs with long HCDR3s, high levels of somatic hypermutations.

Various antibodies names are used throughout the application. Below is listing of antibodies names correlation: CH490=CH235.6; CH491=CH235.7; CH492=CH235.8; CH493=CH235.9; CH555=CH235.10; CH556=CH235.11; CH557=CH235.12. CH and DH prefixes are used interchangeably, e.g. CH235 and DH235.

TABLE 1A

Summary of CH505 proteins and sequences. (1) See WO2014042669 (e.g. at FIG. 17). All of the listed envelopes are designed to include G458Mut, have glycosylation profile similar to the glycosylation profile of envelopes grown in GnTI$^{-/-}$ cells, or have both modifications. For specific non-limiting embodiments of G458Y envelope designs see inter alia Example 10, FIGS. 59, 80-82.

| | gp160 | gp120 delta8 | gp145 | chim.6R. SOSIP.664 (SOSIP.I) | chim.6R.DS. SOSIP.664 (SIOSIP.II) | CHIM.6R. SOSIP.664V4.1 (SOSIP.III) | CHIM.6R. SOSIP.664V4.2 |
|---|---|---|---|---|---|---|---|
| CH505 TF aa One embodiment of a nucleic acid | (1) (1) | (1) (1) | | FIG. 23A | FIG. 23A | FIG. 23A | FIG. 23A |
| W53.16 One embodiment of a nucleic acid | (1) (1) | (1) (1) | | FIG. 23A | FIG. 23A | FIG. 23A | FIG. 23A |
| W78.33 One embodiment of a nucleic acid | (1) (1) | (1) (1) | | | | FIG. 23A | FIG. 23A |
| W100.B6 One embodiment of a nucleic acid | (1) (1) | (1) (1) | | | | FIG. 23A | FIG. 23A |
| M5 aa One embodiment of a nucleic acid | FIG. 17B | FIG. 17A | FIG. 19A | | | FIG. 23A | FIG. 23A |
| M11 aa One embodiment of a nucleic acid | FIG. 17B | FIG. 19A | FIG. 19A | | | FIG. 23A | FIG. 23A |
| W20.14 aa One embodiment of a nucleic acid | FIG. 17B | FIG. 19A | FIG. 19A | | | FIG. 23A | FIG. 23A |
| W30.20 aa One embodiment of a nucleic acid | FIG. 17B | FIG. 19A | FIG. 19A | | | FIG. 23A | FIG. 23A |
| W30.12 aa One embodiment of a nucleic acid | FIG. 17B | FIG. 19A | FIG. 19A | | | FIG. 23A | FIG. 23A |
| W136.B18 aa One embodiment of a nucleic acid | FIG. 19B | FIG. 19A | FIG. 19A | | | FIG. 23A | FIG. 23A |
| W30.25 aa One embodiment of a nucleic acid | FIG. 17A FIG. 17B | | | | | FIG. 23A | FIG. 23A |
| W053.25 aa One embodiment of a nucleic acid | FIG. 17A FIG. 17B | | | | | FIG. 23A | FIG. 23A |
| W053.29 aa One embodiment of a nucleic acid | FIG. 17A FIG. 17B | | | | | FIG. 23A | FIG. 23A |

TABLE 1B

Summary of various trimer designs for CH505 M5 G458Y envelopes

| Design | One embodiment of Amino acid sequence CH505 M5 | CH505 M5 G458Y | One embodiment of nucleic acid sequence |
|---|---|---|---|
| gp160 | FIG. 17B | FIG. 81 | FIG. 82 |
| gp120; | | FIG. 81 | |
| gp120delta8 | FIG. 17A | FIG. 59C #3 | FIG. 59D |
| gp140 | | FIG. 81 | |
| gp145 | FIG. 19A | | |
| chim.6R.SOSIP.664 (SOSIP.I) | | FIG. 81; | |
| chim.6R.DS.SOSIP.664 (SIOSIP.II) | | FIG. 59C #5 | FIG. 59D |
| CHIM.6R.SOSIP.664V4.1 (SOSIP.III) | | FIG. 81; 59C #1 | FIG. 59D |
| CHIM.6R.SOSIP.664V4.2 | FIG. 23A | | |
| CHIM.6R.SOSIP.664V4.1.1 (aka A73C A561C to form another S—S bond) | | FIG. 59C #8 | FIG. 59D |
| chim.6R.SOSIP.664v5.2.8 | | FIG. 59C #6 | FIG. 59D |
| chim.6R.SOSIP.664v4.1 ferritin | | FIG. 59C #4 | FIG. 59D |
| chim.6R.SOSIP.664v4.1avi | | FIG. 59C #7 | FIG. 59D |

CHIM.6R.SOSIP.664V4.2 design includes a mutation of the amino acid sequence corresponding to position 66 of HXB2 sequence. A skilled artisan can readily incorporate this mutation in any other envelope design, including but not limited to CH505 M5 G458.

It is readily understood that the envelope glycoproteins referenced in various examples and figures comprise a signal/leader sequence. It is well known in the art that HIV-1 envelope glycoprotein is a secretory protein with a signal or leader peptide sequence that is removed during processing and recombinant expression (without removal of the signal peptide, the protein is not secreted). See for example Li et al. Control of expression, glycosylation, and secretion of HIV-1 gp120 by homologous and heterologous signal sequences. Virology 204(1):266-78 (1994) ("Li et al. 1994"), at first paragraph, and Li et al. Effects of inefficient cleavage of the signal sequence of HIV-1 gp120 on its association with calnexin, folding, and intracellular transport. PNAS 93:9606-9611 (1996) ("Li et al. 1996"), at 9609. Any suitable signal sequence could be used. In some embodiments the leader sequence is the endogenous leader sequence. Most of the gp120 and gp160 amino acid sequences include the endogenous leader sequence. In other non-limiting examples the leaders sequence is human Tissue Plasminogen Activator (TPA) sequence, human CD5 leader sequence (e.g. MPMGSLQPLATLYLLGMLVASVLA (SEQ ID NO: 7)). Most of the chimeric designs include CD5 leader sequence. A skilled artisan appreciates that when used as immunogens, and for example when recombinantly produced, the amino acid sequences of these proteins do not comprise the leader peptide sequences.

Nomenclature for trimers: chim.6R.DS.SOSIP.664 is SOSIP.I CHIM.6R.SOSIP.664 is SOSIP.II; CHIM.6R.SOSIP.664V4.1 is SOSIP.III. Additional trimer designs are listed inter alia in Tables 1A-B, FIGS. 23, 59 and 81-82.

The specific mutations in any one of the designs could be incorporated in any suitable envelope. For example, using as a guide the CH505 T/F designs in Tables 1A-B, CH505 M envelope can be designed as any trimer.

The invention provides various envelopes and selection of envelopes for use as immunoges, wherein the various envelope sequences and design further comprise change of amino acid position 458 form a Gly (G) to a large amino acid, e.g. but not limited to G458Y, and wherein in some embodiments the envelope has a glycosylation profile similar to the glycosylation profile of an envelope grown in GnTI$^{-/-}$ cells. Amino acid position G458 is with reference to the CH505 T/F envelope and a skilled artisan can readily determine the corresponding position and amino acid in other envelopes. Any one of the envelopes of the invention could be designed and expressed as described in the specification.

The invention is described in the following non-limiting examples.

EXAMPLES

Example 1

HIV-1 sequences, including envelopes, and antibodies from HIV-1 infected individual CH505 were isolated as described in Liao et al. (2013) Nature 496, 469-476 including supplementary materials; See also Gao et al. (2014) Cell 158:481-491.

Recombinant HIV-1 Proteins

HIV-1 Env genes for subtype B, 63521, subtype C, 1086, and subtype CRF_01, 427299, as well as subtype C, CH505 autologous transmitted/founder Env were obtained from acutely infected HIV-1 subjects by single genome amplification, codon-optimized by using the codon usage of highly expressed human housekeeping genes, de novo synthesized (GeneScript) as gp140 or gp120 (AE.427299) and cloned into a mammalian expression plasmid pcDNA3.1/hygromycin (Invitrogen). Recombinant Env glycoproteins were produced in 293F cells cultured in serum-free medium and transfected with the HIV-1 gp140- or gp120-expressing pcDNA3.1 plasmids, purified from the supernatants of transfected 293F cells by using Galanthus nivalis lectin-agarose (Vector Labs) column chromatography, and stored at −80° C. Select Env proteins made as CH505 transmitted/founder Env were further purified by superose 6 column chromatography to trimeric forms, and used in binding assays that showed similar results as with the lectin-purified oligomers.

ELISA

Binding of patient plasma antibodies and CH103, and DH235(CH235), See Gao et al. (2014) Cell 158:481-491, clonal lineage antibodies to autologous and heterologous HIV-1 Env proteins was measured by ELISA as described previously. Plasma samples in serial threefold dilutions starting at 1:30 to 1:521,4470 or purified monoclonal antibodies in serial threefold dilutions starting at 100 μg ml-1 to 0.000 μg ml-1 diluted in PBS were assayed for binding to autologous and heterologous HIV-1 Env proteins. Binding of biotin-labelled CH103 at the subsaturating concentration was assayed for cross-competition by unlabeled HIV-1 antibodies and soluble CD4-Ig in serial fourfold dilutions starting at 10 μg ml-1. The half-maximal effective concentration (EC50) of plasma samples and monoclonal antibodies to HIV-1 Env proteins were determined and expressed as either the reciprocal dilution of the plasma samples or concentration of monoclonal antibodies.

Surface Plasmon Resonance Affinity and Kinetics Measurements

Binding Kd and rate constant (association rate (Ka)) measurements of monoclonal antibodies and all candidate UCAs to the autologous Env C. CH05 gp140 and/or the heterologous Env B.63521 gp120 are carried out on BIAcore 3000 instruments as described previously. Anti-human IgG Fc antibody (Sigma Chemicals) is immobilized on a CMS sensor chip to about 15,000 response units and each antibody is captured to about 50-200 response units on three individual flow cells for replicate analysis, in addition to having one flow cell captured with the control Synagis (anti-RSV) monoclonal antibody on the same sensor chip. Double referencing for each monoclonal antibody—HIV-1 Env binding interactions is used to subtract nonspecific binding and signal drift of the Env proteins to the control surface and blank buffer flow, respectively. Antibody capture level on the sensor surface is optimized for each monoclonal antibody to minimize rebinding and any associated avidity effects. C.CH505 Env gp140 protein is injected at concentrations ranging from 2 to 25 μg ml-1, and B.63521 gp120 was injected at 50-400 μg ml-1 for UCAs and early intermediates IA8 and IA4, 10-100 μg ml-1 for intermediate IA3, and 1-25 μg ml-1 for the distal and mature monoclonal antibodies. All curve-fitting analyses are performed using global fit of to the 1:1 Langmuir model and are representative of at least three measurements. All data analysis was performed using the BIAevaluation 4.1 analysis software (GE Healthcare).

Neutralization Assays

Neutralizing antibody assays in TZM-bl cells are performed as described previously. Neutralizing activity of plasma samples in eight serial threefold dilutions starting at 1:20 dilution and for recombinant monoclonal antibodies in eight serial threefold dilutions starting at 50 μg ml-1 are tested against autologous and herologous HIV-1 Env-pseudotyped viruses in TZM-bl-based neutralization assays using the methods known in the art. Neutralization breadth of CH103 is determined using a panel of 196 of geographically and genetically diverse Env-pseudoviruses representing the major circulated genetic subtypes and circulating recombinant forms. HIV-1 subtype robustness is derived from the analysis of HIV-1 clades over time. The data are calculated as a reduction in luminescence units compared with control wells, and reported as IC50 in either reciprocal dilution for plasma samples or in micrograms per microlitre for monoclonal antibodies.

The GenBank accession numbers for 292 CH505 Env proteins are KC247375-KC247667, and accessions for 459 $V_H DJ_H$ and 174 $V_L J_L$ sequences of antibody members in the CH103 clonal lineage are KC575845-KC576303 and KC576304-KC576477, respectively.

Example 2

Binding of Sequential Envelopes to CH103 and CH235 CD4 Binding Site bnAb Lineages Members.

The binding assay was an ELISA with the envelope protein bound to the well surface of a 96 well plate, and the antibody in questions incubated with the envelope bound to the plate. After washing, an enzyme-labeled anti-human IgG antibody was added and after incubation, washed away. The intensity of binding was determined by the intensity of enzyme-activated color in the well.

TABLE 2

ELISA binding, log-transformed area under the curve (AUC) values for a realization with four Env-derived gp120 antigens, assayed against members of the CH103 bnAb lineage from universal ancestor (UCA), through intermediate ancestors (IA8-IA1) to the mature bnAb. Values of 0 indicate no binding. The transmitted-founder (TF) antigen was derived from Env w004.3.

| Antigen | UCA | IA8 | IA7 | IA6 | IA4 | IA3 | CH105 | IA2 | CH104 | IA1 | CH106 | CH103 |
|---|---|---|---|---|---|---|---|---|---|---|---|---|
| TF | 3.5 | 5.5 | 9.2 | 9.1 | 10.1 | 11 | 11.2 | 10.8 | 10.4 | 10.4 | 11.3 | 12.6 |
| w053.16 | 0 | 0 | 0 | 0 | 0.2 | 1.1 | 9 | 9.3 | 9.9 | 8.8 | 9.8 | 11.6 |
| w078.33 | 0 | 0 | 0 | 0 | 0 | 0 | 8.9 | 9 | 9 | 8.2 | 9.5 | 11.1 |
| w100.B6 | 0 | 0 | 0 | 0 | 0 | 0 | 11 | 12.1 | 11 | 12.2 | 11.8 | 7.1 |

TABLE 3

ELISA binding, log-transformed area under the curve (AUC) values for a realization with five Env-derived gp120 antigens, assayed against members of the CH103 bnAb lineage from universal ancestor (UCA), through intermediate ancestors (IA8-IA1) to the mature bnAb. Values of 0 indicate no binding. Antigen names beginning with M were synthesized by site-directed mutagenesis.

| Antigen | UCA | IA8 | IA7 | IA6 | IA4 | IA3 | CH105 | IA2 | CH104 | IA1 | CH106 | CH103 |
|---|---|---|---|---|---|---|---|---|---|---|---|---|
| M11 | 2.6 | 6.2 | 10.1 | 10 | 10.5 | 11.8 | 11.7 | 12.7 | 12 | 12.2 | 12.8 | 13.4 |
| M5 | 0 | 0.6 | 2.3 | 3.3 | 3.8 | 6.8 | 8.6 | 7.8 | 9 | 7 | 8.4 | 9.8 |
| w020.14 | 0.3 | 3.4 | 7.2 | 7.9 | 8.6 | 9.5 | 10.4 | 11 | 10.4 | 10.3 | 11.2 | 12.6 |
| w030.28 | 0 | 1.6 | 3.5 | 6.3 | 6.5 | 7.7 | 9.1 | 11.1 | 10.7 | 10.1 | 11.7 | 12.8 |
| w078.15 | 0 | 0 | 0.7 | 1 | 1.3 | 3 | 10.1 | 11.5 | 10.8 | 10.9 | 11 | 10.7 |
| w053.31 | 0 | 0 | 0 | 0 | 0 | 0 | 13.5 | 13.3 | 13.7 | 13.4 | 13.4 | 13.6 |

TABLE 4

ELISA binding, log-transformed area under the curve (AUC) values for a realization with five Env-derived gp120 antigens, assayed against members of the DH235 (CH235) bnAb helper lineage from universal ancestor (UCA), through intermediate ancestors (I4-I1) to mature bnAbs. Values of 0 indicate no binding. Antigen names beginning with M were synthesized by site-directed mutagenesis.

| Antigen | UCA | I4 | I3 | I2 | I1 | DH235 | CH236 | CH239 | CH240 | CH241 |
|---|---|---|---|---|---|---|---|---|---|---|
| M11 | 0 | 0 | 0 | 0 | 2.8 | 7.6 | 1.4 | 1.4 | 0.5 | 9.7 |
| M5 | 0.2 | 1.4 | 7 | 6.9 | 9.2 | 11.4 | 7.3 | 12.9 | 7.4 | 14.5 |
| w020.14 | 0 | 0 | 2.7 | 1.2 | 6.5 | 9.9 | 6.7 | 9 | 3.8 | 13.1 |

TABLE 4-continued

ELISA binding, log-transformed area under the curve (AUC) values for a realization
with five Env-derived gp120 antigens, assayed against members of the DH235
(CH235) bnAb helper lineage from universal ancestor (UCA), through intermediate
ancestors (I4-I1) to mature bnAbs. Values of 0 indicate no binding. Antigen
names beginning with M were synthesized by site-directed mutagenesis.

| Antigen | UCA | I4 | I3 | I2 | I1 | DH235 | CH236 | CH239 | CH240 | CH241 |
|---|---|---|---|---|---|---|---|---|---|---|
| w030.28 | 0 | 0 | 0 | 0 | 2.4 | 6.7 | 1.5 | 3.6 | 0.3 | 9.6 |
| w078.15 | 0 | 0 | 0 | 0 | 0 | 0 | 0 | 0 | 0 | 0 |
| w053.31 | 0 | 0 | 0 | 0 | 0 | 1.1 | 0 | 0 | 0 | 1.4 |

TABLE 5

ELISA binding, log-transformed area under the curve (AUC) values for a realization that embodies
ten Env-derived gp120 antigens, assayed against members of the CH103 bnAb lineage from universal
ancestor (UCA), through intermediate ancestors (IA8-IA1) to the mature bnAb. Values of 0 indicate
no binding. Antigen names beginning with M were synthesized by site-directed mutagenesis.

| Antigen | UCA | IA8 | IA7 | IA6 | IA4 | IA3 | CH105 | IA2 | CH104 | IA1 | CH106 | CH103 |
|---|---|---|---|---|---|---|---|---|---|---|---|---|
| M11 | 2.6 | 6.2 | 10.1 | 10 | 10.5 | 11.8 | 11.7 | 12.7 | 12 | 12.2 | 12.8 | 13.4 |
| M5 | 0 | 0.6 | 2.3 | 3.3 | 3.8 | 6.8 | 8.6 | 7.8 | 9 | 7 | 8.4 | 9.8 |
| w020.14 | 0.3 | 3.4 | 7.2 | 7.9 | 8.6 | 9.5 | 10.4 | 11 | 10.4 | 10.3 | 11.2 | 12.6 |
| w030.28 | 0 | 1.6 | 3.5 | 6.3 | 6.5 | 7.7 | 9.1 | 11.1 | 10.7 | 10.1 | 11.7 | 12.8 |
| w078.15 | 0 | 0 | 0.7 | 1 | 1.3 | 3 | 10.1 | 11.5 | 10.8 | 10.9 | 11 | 10.7 |
| w053.16 | 0 | 0 | 0 | 0 | 0.2 | 1.1 | 9 | 9.3 | 9.9 | 8.8 | 9.8 | 11.6 |
| w030.21 | 0 | 0 | 0 | 0 | 0 | 0 | 10.6 | 11.5 | 11.3 | 11.8 | 10.9 | 12.2 |
| w078.33 | 0 | 0 | 0 | 0 | 0 | 0 | 8.9 | 9 | 9 | 8.2 | 9.5 | 11.1 |
| w100.B6 | 0 | 0 | 0 | 0 | 0 | 0 | 11 | 12.1 | 11 | 12.2 | 11.8 | 7.1 |
| w053.31 | 0 | 0 | 0 | 0 | 0 | 0 | 13.5 | 13.3 | 13.7 | 13.4 | 13.4 | 13.6 |

Example 3

Combinations of Antigens Derived from CH505 Envelope Sequences for Swarm Immunizations Provided herein are non-limiting examples of combinations of antigens derived from CH505 envelope sequences for a swarm immunization. Without limitations, these selected combinations comprise envelopes which provide representation of the sequence and antigenic diversity of the HIV-1 envelope variants which lead to the induction and maturation of the CH103 and CH235 antibody lineages. The identification of bnAb lineage (CH103) and envelopes which bind preferentially to various members of this lineage provides a direct strategy for the selection of Envs (out of millions possible envelopes naturally occurring in an HIV-1 infected individual) that might have engaged UCA and participated in bnAb development, and thus could serve as immunogens in a vaccine formulation. The identification of helper lineage (CH235) and envelopes which bind preferentially to various members this lineage provides a direct strategy for the selection of Envs (out of millions possible envelopes naturally occurring in an HIV-1 infected individual) that might have engaged UCA and participated in bnAb development, and thus could serve as immunogens in a vaccine formulation.

The selection includes priming with a virus which binds to the UCA, for example a T/F virus or another early (e.g. but not limited to week 004.3, or 004.26) virus envelope. In certain embodiments the prime could include D-loop variants. In certain embodiments the boost could include D-loop variants. In certain embodiments, these D-loop variants are envelope escape mutants not recognized by the UCA. Non-limiting examples of such D-loop variants are envelopes designated as M10, M11, M19, M20, M21, M5, M6, M7, M8, M9, M14 (TF_M14), M24 (TF_24), M15, M16, M17, M18, M22, M23, M24, M25, M26. See Gao et al. (2014) Cell 158:481-491.

Non-limiting embodiments of envelopes selected for swarm vaccination are shown as the selections described below. A skilled artisan would appreciate that a vaccination protocol can include a sequential immunization starting with the "prime" envelope(s) and followed by sequential boosts, which include individual envelopes or combination of envelopes. In another vaccination protocol, the sequential immunization starts with the "prime" envelope(s) and is followed with boosts of cumulative prime and/or boost envelopes. In certain embodiments, the sequential immunization starts with the "prime" envelope(s) and is followed by boost(s) with all or various combinations of the envelopes in the selection. In certain embodiments, the prime does not include T/F sequence (W000.TF). In certain embodiments, the prime includes w004.03 envelope. In certain embodiments, the prime includes w004.26 envelope. In certain embodiment the prime includes M11. In certain embodiments the prime includes M5. In certain embodiments, the immunization methods do not include immunization with HIV-1 envelope T/F. In certain embodiments, the immunization methods do not include a schedule of four valent immunization with HIV-1 envelopes T/F, w053.16, w078.33, and w100.B6.

In certain embodiments, there is some variance in the immunization regimen; in some embodiments, the selection of HIV-1 envelopes may be grouped in various combinations of primes and boosts, either as nucleic acids, proteins, or combinations thereof.

In certain embodiments the immunization includes a prime administered as DNA, and MVA boosts. See Goepfert, et al. 2014; "Specificity and 6-Month Durability of Immune Responses Induced by DNA and Recombinant Modified Vaccinia Ankara Vaccines Expressing HIV-1 Virus-Like Particles" J Infect Dis. 2014 Feb. 9. [Epub ahead of print].

HIV-1 Envelope selection A (five envelopes): M11; w020.14; w030.28; w078.15; w053.31

HIV-1 Envelope selection B (six envelopes): M11; M5; w020.14; w030.28; w078.15; w053.31

HIV-1 Envelope selection C (ten envelopes): M11; M5; w020.14; w030.28; w078.15; w053.16; w030.21; w078.33; w100.B6; w053.31.

HIV-1 Envelopes selection D (six envelopes): M5, M11, 20.14, 30.28, 30.23, 136.B18.

HIV-1 Envelopes selection E (six envelopes): M5, M11, 20.14, 30.20, 30.23, 136.B18.

HIV-1 Envelopes selection F (six envelopes—P186 study): M5, M11, 20.14, 30.20, 30.12, 136.B18.

HIV-1 envelope selection G (EnvSeq-2): M5, 30.25; 53.25; 53.29.

HIV-1 envelope selection H (EnvSeq-3): M5, 30.20; 20.14, 30.12.

HIV-1 envelope selection I: T/F, 53.16, optionally 78.33, 100.B6, or any other suitable envelope, wherein each envelope comprises G458mutation, e.g. G458Y.

Selections using M5 as a prime, e.g. but not limited to D, E, F, G or H are expected to engage receptors and drive progression of CH235 lineage of antibodies.

The selections of CH505-Envs were down-selected from a series of 400 CH505 Envs isolated by single-genome amplification followed for 3 years after acute infection, based on experimental data. The enhanced neutralization breadth that developed in the CD4-binding site (bs) CH103 antibody lineage that arose in subject CH505 developed in conjunction with epitope diversification in the CH505's viral quasispecies. It was observed that at 6 months post-infection there was more diversification in the CD4bs epitope region in this donor than sixteen other acutely infected donors. Population breadth did not arise in the CH103 antibody lineage until the epitope began to diversify. A hypothesis is that the CH103 linage drove viral escape, but then the antibody adapted to the relatively resistant viral variants. As this series of events was repeated, the emerging antibodies evolved to tolerate greater levels of diversity in relevant sites, and began to be able to recognize and neutralize diverse heterologous forms for the virus and manifest population breadth. In certain embodiments, six envs are selected from CH505 sequences to reflect diverse variants for making Env pseudoviruses, with the goal of recapitulating CH505 HIV-1 antigenic diversity over time, making sure selected site (i.e. those sites reflecting major antigenic shifts) diversity was represented.

Specifically, for CH505 the virus and envelope evolution were mapped, and the CH103 CD4 binding-site bnAb evolution. In addition, 135 CH505 varied envelope pseudotyped viruses were made and tested them for neutralization sensitivity by members of the CH103 bnAb lineage (e.g, FIG. 3). From this large dataset, in one embodiment, six Env variants were chosen for immunization based on sequence diversity, and antigenic diversity, for example binding to antibodies in the CH103 and/or CH235 lineage (Tables 3-5).

In certain embodiments, the envelopes are selected based on Env mutants with sites under diversifying selection, in which the transmitted/founder (T/F) Env form vanished below 20% in any sample, i.e. escape variants; signature sites based on autologous neutralization data, i.e. Envs with statistically supported signatures for escape from members of the CH103 bnAb lineage; and sites with mutations at the contact sites of the CH103 antibody and HIV Env. In this manner, a sequential swarm of Envs was selected for immunization to represent the progression of virus escape mutants that evolved during bnAb induction and increasing neutralization breadth in the CH505 donor.

In certain embodiments, additional sequences are selected to contain five additional specific amino acid signatures of resistance that were identified at the global population level. These sequences contain statistically defined resistance signatures, which are common at the population level and enriched among heterologous viruses that CH103 fails to neutralize. When they were introduced into the TF sequence, they were experimentally shown to confer partial resistance to antibodies in the CH103 lineage. Following the reasoning that serial viral escape and antibody adaptation to escape is what ultimate selects for neutralizing antibodies that exhibit breadth and potency against diverse variants, in certain embodiments, inclusion of these variants in a vaccine may extend the breadth of vaccine-elicited antibodies even beyond that of the CH103 lineage. Thus the overarching goal will be to trigger a CH103-like lineage first using the CH505TF modified M11, that is well recognized by early CH103 ancestral states, then vaccinating with antigenic variants, to allow the antibody lineage to adapt through somatic mutation to accommodate the natural variants that arose in CH505. In certain embodiments, vaccination regimens include a total of five sequences (Selection A) that capture the antigenic diversity of CH505. In another embodiment, additional antigenic diversity is added (Selection B and C), to enable the induction of antibodies by vaccination that may have even greater breadth than those antibodies isolated from CH505.

In some embodiments, the CH505 sequences that represent the accumulation of viral sequence and antigenic diversity in the CD4bs epitope of CH103 in subject CH505 are represented by selection A, selection B, or selection C.

M11 is a mutant generated to include two mutations in the loop D (N279D+V281G relative to the TF sequence) that enhanced binding to the CH103 lineage. These were early escape mutations for another CD4bs autologous neutralizing antibody lineage, but might have served to promote early expansion of the CH103 lineage.

In certain embodiments, the two CH103 resistance signature-mutation sequences added to the antigenic swarm are: M14 (TF with S364P), and M24 (TF with S375H+ T202K+L520F+G459E). They confer partial resistance to the TF with respect to the CH103 lineage. In certain embodiments, these D-loop mutants are administered in the boost.

Example 4

Immunization Protocols in Subjects with Swarms of HIV-1 Envelopes.

Immunization protocols contemplated by the invention include envelopes sequences as described herein including but not limited to nucleic acids and/or amino acid sequences of gp160s, gp150s, gp145, cleaved and uncleaved gp140s, stabilized trimers, e.g. but not limited to SOSIP trimers, gp120s, gp41s, N-terminal deletion variants as described herein, cleavage resistant variants as described herein, or codon optimized sequences thereof. A skilled artisan can readily modify the gp160 and gp120 sequences described herein to obtain these envelope variants. The swarm immunization selections can be administered in any subject, for example monkeys, mice, guinea pigs, or human subjects.

In non-limiting embodiments, the immunization includes a nucleic acid which is administered as DNA, for example in a modified vaccinia vector (MVA). In non-limiting embodiments, the nucleic acids encode gp160 envelopes. In other embodiments, the nucleic acids encode gp120 envelopes. In other embodiments, the boost comprises a recombinant gp120 envelope. The vaccination protocols include envelopes formulated in a suitable carrier and/or adjuvant, for example but not limited to alum. In certain embodiments the immunizations include a prime, as a nucleic acid or a recombinant protein, followed by a boost, as a nucleic acid or a recombinant protein. A skilled artisan can readily determine the number of boosts and intervals between boosts.

In some embodiments, the immunization methods comprise immunization prime with a nucleic acid, for example but not limited to priming two times with DNA. In some embodiments the nucleic acid prime is administered one, two, three or four times. In some embodiments the two DNA prime is administered via electroporation (DNA-EP). In some embodiments, the primer and boost is administered as RNA. The primes are followed by boost with sequential envelopes. The boosting envelopes could be in any suitable form, e.g. but not limited to gp140s, as soluble or stabilized SOSIP trimers.

Table 6 shows a non-limiting example of an immunization protocol using a selection of HIV-1 envelopes

| Envelope | Prime | Boost(s) | Boost(s) | Boost(s) |
|---|---|---|---|---|
| M11 | M11 as a nucleic acid e.g. DNA/MVA vector and/or protein | | | |
| W020.14 | | W020.14 as a nucleic acid e.g. DNA/MVA and/or protein | | |
| W030.28 | | | W030.28 as nucleic acid e.g. DNA/MVA and/or protein | |
| W078.15 | | | w078.15 as nucleic acid e.g. DNA/MVA and/or protein | |
| W100.B6 | | | | W100.B6 as nucleic acid e.g. DNA/MVA and/or protein |

Table 7 shows a non-limiting example of an immunization protocol using a selection of HIV-1 envelopes

| Envelope | Prime | Boost(s) | Boost(s) | Boost(s) |
|---|---|---|---|---|
| M11 | M11 as a nucleic acid e.g. DNA/MVA vector and/or protein | M11 as a nucleic acid e.g. DNA/MVA vector and/or protein | M11 as a nucleic acid e.g. DNA/MVA vector and/or protein | M11 as a nucleic acid e.g. DNA/MVA vector and/or protein |
| W020.14 | | W020.14 as a nucleic acid e.g. DNA/MVA and/or protein | W020.14 as a nucleic acid e.g. DNA/MVA and/or protein | W020.14 as a nucleic acid e.g. DNA/MVA and/or protein |
| W030.28 | | | W030.28 as nucleic acid e.g. DNA/MVA and/or protein | W030.28 as nucleic acid e.g. DNA/MVA and/or protein |
| W078.15 | | | w078.15 as nucleic acid e.g. DNA/MVA and/or protein | w078.15 as nucleic acid e.g. DNA/MVA and/or protein |
| W100.B6 | | | | W100.B6 as nucleic acid e.g. DNA/MVA and/or protein |

In certain embodiments, after administering a prime with M11, subsequent immunizations include all other envelopes as nucleic acids and/or proteins.

Table 8 shows a non-limiting example of an immunization protocol using a swarm of HIV-1 envelopes

| Envelope | Prime | Prime/Boost | Boost(s) | Boost(s) | Boost(s) |
|---|---|---|---|---|---|
| M11 | M11 as a nucleic acid e.g. DNA/MVA vector and/or protein | | | | |
| M5 | | M5 as a nucleic acid e.g. DNA/MVA and/or protein | | | |
| W020.14 | | | W020.14 as a nucleic acid e.g. DNA/MVA and/or protein | | |
| W030.28 | | | | W030.28 as nucleic acid e.g. DNA/MVA and/or protein | |
| W078.15 | | | | w078.15 as nucleic acid e.g. DNA/MVA and/or protein | |
| W100.B6 | | | | | W100.B6 as nucleic acid e.g. DNA/MVA and/or protein |

Table 9 shows a non-limiting example of an immunization protocol using a swarm of HIV-1 envelopes

| Envelope | Prime | Prime/Boost | Boost(s) | Boost(s) | Boost(s) |
|---|---|---|---|---|---|
| M11 | M11 as a nucleic acid e.g. DNA/MVA vector and/or protein | M11 as a nucleic acid e.g. DNA/MVA vector and/or protein | M11 as a nucleic acid e.g. DNA/MVA vector and/or protein | M11 as a nucleic acid e.g. DNA/MVA vector and/or protein | M11 as a nucleic acid e.g. DNA/MVA vector and/or protein |
| M5 | Optionally M5 as a nucleic acid e.g. DNA/MVA and/or protein | M5 as a nucleic acid e.g. DNA/MVA and/or protein | M5 as a nucleic acid e.g. DNA/MVA and/or protein | M5 as a nucleic acid e.g. DNA/MVA and/or protein | M5 as a nucleic acid e.g. DNA/MVA and/or protein |
| W020.14 | | | W020.14 as a nucleic acid e.g. DNA/MVA and/or protein | W020.14 as a nucleic acid e.g. DNA/MVA and/or protein | W020.14 as a nucleic acid e.g. DNA/MVA and/or protein |
| W030.28 | | | | W030.28 as nucleic acid e.g. DNA/MVA and/or protein | W030.28 as nucleic acid e.g. DNA/MVA and/or protein |
| W078.15 | | | | w078.15 as nucleic acid e.g. DNA/MVA and/or protein | w078.15 as nucleic acid e.g. DNA/MVA and/or protein |
| W100.B6 | | | | | W100.B6 as nucleic acid e.g. DNA/MVA and/or protein |

In certain embodiments, after administering a prime with M11 and optionally with M5, subsequent immunizations include all other envelopes as nucleic acids and/or proteins.

Table 10 shows a non-limiting example of immunization protocol using a selection of ten HIV-1 envelopes

| Envelope | Prime | Prime/Boost | Boost(s) | Boost(s) | Boost(s) | Boost(s) | Boost(s) | Boost(s) |
|---|---|---|---|---|---|---|---|---|
| M11 | M11 as a nucleic acid e.g. DNA/MVA vector and/or protein | | | | | | | |
| M5 | | M5 as a nucleic acid e.g. DNA/MVA and/or protein | | | | | | |
| W020.14 | | | W020.14 as a nucleic acid e.g. DNA/MVA and/or protein | | | | | |
| W030.28 | | | | W030.28 as nucleic acid e.g. DNA/MVA and/or protein | | | | |
| W078.15 | | | | w078.15 as nucleic acid e.g. DNA/MVA and/or protein | | | | |
| W053.16 | | | | | W053.16 as nucleic acid e.g. DNA/MVA and/or protein | | | |
| W030.21 | | | | | | W030.21 as nucleic acid e.g. DNA/MVA and/or protein | | |
| W078.33 | | | | | | | W078.33 as nucleic acid e.g. DNA/MVA and/or protein | |

-continued

| Envelope | Prime | Prime/Boost | Boost(s) | Boost(s) | Boost(s) | Boost(s) | Boost(s) | Boost(s) | Boost(s) |
|---|---|---|---|---|---|---|---|---|---|
| W100.B6 | | | | | | | | W100.B6 as nucleic acid e.g. DNA/MVA and/or protein | |
| W053.31 | | | | | | | | | W053.31 as nucleic acid e.g. DNA/MVA and/or protein |

Table 11 shows a non-limiting example of immunization protocol using a selection of six HIV-1 envelopes

| Envelope | Prime | Prime/Boost | Boost(s) | Boost(s) | Boost(s) |
|---|---|---|---|---|---|
| M11 | M11 as a nucleic acid e.g. DNA/MVA vector and/or protein | M11 as a nucleic acid e.g. DNA/MVA vector and/or protein | M11 as a nucleic acid e.g. DNA/MVA vector and/or protein | M11 as a nucleic acid e.g. DNA/MVA vector and/or protein | M11 as a nucleic acid e.g. DNA/MVA vector and/or protein |
| M5 | Optionally M5 as a nucleic acid e.g. DNA/MVA and/or protein | M5 as a nucleic acid e.g. DNA/MVA and/or protein | M5 as a nucleic acid e.g. DNA/MVA and/or protein | M5 as a nucleic acid e.g. DNA/MVA and/or protein | M5 as a nucleic acid e.g. DNA/MVA and/or protein |
| W020.14 | | | W020.14 as a nucleic acid e.g. DNA/MVA and/or protein | W020.14 as a nucleic acid e.g. DNA/MVA and/or protein | W020.14 as a nucleic acid e.g. DNA/MVA and/or protein |
| W030.20 | | | | W030.20 as nucleic acid e.g. DNA/MVA and/or protein | W030.20 as nucleic acid e.g. DNA/MVA and/or protein |
| W030.12 | | | | | w030.12 as nucleic acid e.g. DNA/MVA and/or protein |
| W136.B18 | | | | | W136.B18 as nucleic acid e.g. DNA/MVA and/or protein |

Table 12 shows a non-limiting example of immunization protocol using a selection of six HIV-1 envelopes

| Envelope | Prime | Boost(s) | Boost(s) | Boost(s) | Boost(s) |
|---|---|---|---|---|---|
| M11 | M11 as a nucleic acid e.g. DNA/MVA vector and/or protein | | | | |
| M5 | Optionally M5 as a nucleic acid e.g. DNA/MVA and/or protein | | | | |
| W020.14 | | W020.14 as a nucleic acid e.g. DNA/MVA and/or protein | | | |
| W030.20 | | | W030.20 as nucleic acid e.g. DNA/MVA and/or protein | | |
| W030.12 | | | | w030.12 as nucleic acid e.g. DNA/MVA and/or protein | |
| W136.B18 | | | | | W136.B18 as nucleic acid e.g. DNA/MVA and/or protein |

In certain embodiments, after administering a prime with M11 and optionally with M5, subsequent immunizations include sequential or cumulative addition of the other envelopes as nucleic acids and/or proteins.

Table 13 shows a non-limiting example of immunization protocol using a selection of four HIV-1 envelopes

| Envelope | Prime | Boost(s) | Boost(s) | Boost(s) |
|---|---|---|---|---|
| M5 | M5 as a nucleic acid e.g. DNA/MVA vector and/or protein | | | |

-continued

| Envelope | Prime | Boost(s) | Boost(s) | Boost(s) |
|---|---|---|---|---|
| W30.25 | W30.25 as a nucleic acid e.g. DNA/MVA vector and/ or protein | | | |
| W53.25 | | W53.25 as a nucleic acid e.g. DNA/MVA vector and/ or protein | | |
| W53.29 | | | | W53.29 as a nucleic acid e.g. DNA/MVA vector and/ or protein |

In certain embodiments an immunization protocol could prime with a bivalent or trivalent Gag mosaic (Gag 1 and Gag 2, Gag 1, Gag 2 and Gag3) in a suitable vector.

Example 5A

Env Mixtures of the CH505 Virus are Expected to Induce the Beginning of CD4 Binding Site BnAb Lineages CH103 and CH235

The combinations of envelopes described in Examples 2-4 will be tested in any suitable subject. Suitable animal models include without limitation mice, including humanized mice, guinea pigs, or non-human primates (NHPs). For example an animal is administered with the following antigens, as DNA and/or proteins, in any suitable for, in the following immunization schedule: loop D mutant M5 and/or M11. That will give the best CH103 UCA binder (M11) and the best CH235 UCA binder (M5). Immunization 2: week 020.14. Immunization 3: Week 030.28. Immunization 4: week 078.15. Immunization 5: week 100.B6. Immunization 5: swarm of all six envelopes. Adjuvant is a TLR-4 agonist (GLA-synthetic monophosphoryl lipid A) in stable emulsion from Infectious Disease Research Institute, Seattle Wash.

In another embodiment, the prime is M5 and M11. The boost includes 20.14, 30.20, 30.12, and 136.B18, sequentially or additively.

Example 5B

Immunization Elicits Heterologous and Autologous Tier 2 Neutralizing Antibodies.

While improved breadth of vaccine-induced neutralizing antibody responses against tier 2 viruses are needed for a protective HIV-1 vaccine, elicitation of bnAbs by vaccination has proven challenging.

This example shows elicitation of heterologous and autologous tier 2 neutralizing antibodies with sequential Env vaccination in rhesus macaques. See also FIGS. 25-34. The method comprised administering T/F envelope as gp145 DNA via electroporation, followed by boosting with T/F, w053.16, w078.33 and w100.B6 envelopes administered as gp140C envelopes.

Co-evolution studies of the CH103 lineage of antibodies and viruses from the same infected person CH505 provides a roadmap for how bnAbs develop during natural infection (Liao et al. Nature 2014; Bonsignori et al. Cell 2016).

This animal study compared the immunogenicity of CH505 gp140C oligomers to CH505-CD40 conjugates. We hypothesize that a roadblock to bnAb induction by vaccination is the lack of B cell stimulation by antigen presenting cells (dendritic cells and monocytes), and that bNAbs, similar to those in the CH103 bnAb lineage, can be induced by vaccination with sequential Envs from CH505 (TF, w053.16, w078.33 and w100.B6). In this experiment the T/F envelope was administered as a DNA prime. In some animals the boosting envelopes (TF, w053.16, w078.33 and w100.B6) were administered as gp140C envelopes. In some animals these envelopes were targeted to antigen presenting cells by a CD40 antibody—human anti-CD40 IgG4 was linked to the CH505 gp140C.

It is possible that the reduced immunogenicity of the anti-CD40 IgG4-CH505 Env regimen is due to anti-drug antibodies in rhesus macaques.

This example shows that: DNA-EP prime and gp140C oligomer boosts induced autologous tier 2 neutralization in 1 of 4 macaques; heterologous tier 2 neutralization of 9/12 tier 2 isolates was also elicited in the same macaque; and that CD4 binding site directed plasma IgG was present in wild-type Env immunized macaques. RSC3-reactive B cells were sorted from macaques and the binding and neutralization screening is ongoing.

This example demonstrated that sequential Env immunogens, including the sequential immunogens used in this study could induce heterologous Tier 2 neutralizatoin. One alternative to increase the response rate of bnAb induction is the use of sequential near-native soluble CH505 trimers (e.g. but not limited to SOSIP based trimers as described herein). Immunization with CH505 stabilized trimers while modulating immune tolerance with immune checkpoint inhibitors is also underway.

In some embodiments, the immunization methods could comprise immunization prime with a nucleic acid, for example but not limited to priming two times with DNA, In some embodiments the nucleic acid prime is administered one, two, three or four times. In some embodiments the two DNA prime is administered via electroporation (DNA-EP). In some embodiments the nucleic acid encodes any suitable form of the envelope. In some embodiments, the primer and boost is administered as RNA. The primes are followed by boost with sequential envelopes. The boosting envelopes could be in any suitable form, e.g. but not limited to gp140s, as soluble or stabilized SOSIP trimers, e.g. but not limited to SOSIP.III.

Example 6A

Over the past five years, the HIV vaccine development field has realized that immunization with a single HIV envelope protein will not be successful at inducing bnAbs[1,2]. Moreover, with evidence for a role of host immune tolerance control mechanisms in limiting the induction of bnAbs[1,3], the biology of bnAbs has begun to be elucidated. The role of the structure of the Env immunogen is undoubtedly important, as the Env must contain sufficiently native bnAb epitopes to bind in optimal affinities to the unmutated common ancestor (UCA, naïve B cell receptors) of bnAb lineages[2,4]. Thus, the concept of B cell lineage immunogen design has arisen, whereby lineages of bnAbs are elucidated, and Envs chosen for sequential immunizations based on optimized affinity of Env immunogens for BCRs at sequential steps of the affinity maturation pathway of bnAb lineages[2]

While Envs have been designed for reacting with UCAs of heterologous bnAb lineages[4,5], we have taken the approach of defining, in select HIV-infected individuals who make bnAbs, the natural sequence of Envs that induced the bnAb lineages in order to make immunogen down selection an evidence-based decision. While such immunogens are designed for the UCA and intermediate antibodies of one particular bnAb lineage, they hold promise for inducing bnAb lineages in multiple individuals because of the remarkable conserved usage of VH and VL genes of bnAbs and the restricted nature of antibody motifs for many bnAb types, particularly for the gp41 membrane proximal region[6], the CD4 binding site[7] and the V1V2-glycan site[1,8-10].

Two Types of CD4 Binding Site Antibodies

There are several types of CD4 binding site (bs) bnAbs two of which are a) heavy chain complementarity determining region 3 (HCDR3) binders and b) CD4 mimicking bnAbs[7]. HCDR3 binding CD4 binding site bnAbs approach the CD4 binding site with the HCDR3 and other VH and VL loops with multiple loop-based interactions. Several different VHs and VLs are used by HCDR3 binding bnAbs with VH3 and VH4 the most common. In contrast, CD4 mimicking bnAbs have restricted VH usage and either use VH1-2*02 or VH1-46. When VH1-2*02 is used, the light chain LCDR3 must be five amino acids in length. However, when VH1-46 is used, the LCDR3 can be of normal (10-13 aa) in length. Both VH1-2*02 and VH1-46 CD4 mimicking antibodies approach the CD4 binding site in a highly homologous manner to the approach of CD4, and structural analysis of such bnAbs demonstrates both structural similarity to CD4, as well as near identical structures to each of these types of antibodies[7]. Finally, HCDR3 binders are less broad and potent than CD4 mimicking antibodies, with HCDR3 binders neutralizing ~50% of isolates (e.g., CH103, CH98) while CD4 mimickers neutralizing 90-95% of isolates (e.g., CH235.12, VRC01)[7]. Thus, both types of antibodies are desirable to induce with vaccination as components of a polyclonal bnAb response.

The CH505 African HIV-infected individual that makes both types of CD4bs bnAbs over 6 years (See Liao et al. (2013) Nature 496, 469-476 including supplementary materials; See also Gao et al. (2014) Cell 158:481-491; Example 8)

Thus, from African individual CH505, we have isolated both sequential Envs and bnAbs over time, and mapped the co-evolution of two bnAb lineages, the CH103 CD4 binding site HCDR3 binder bnAb lineage[11] and the CH235 CD4 mimicking CD4bs VH1-46 bnAb lineage[12]. The CH103 HCDR3 binder type of CD4 binding site antibody achieved 55% maximum breadth and 4.5 mcg inhibitory concentration 50 (IC50) neutralization of cross-clade HIVs[11]. In contrast, the CH235 CD4 mimicking CD4 binding site antibody achieved 90% neutralization and neutralizing IC50 of 0.7 mcg/ml. Here, we will describe the work of development of sequential Env regimens to induce both of these types of bnAb lineages, and propose here the new sequential Envs to specifically initiate CH235-like CD4 mimicking bnAb lineages.

The EnvSeq-1 Sequential Vaccine from CH505 Designed to Induce HCDR3-Type of CD4 Binding Site bnAbs We have developed a 4-valent immunogen comprised of CH505 envelopes that have been designed to trigger the CH103 lineage UCA to clonally expand and start off CH103-like CD4bs HCDR3-binder types of B cell lineages (TF; w053.16; w078.33; w100.B6 the EnvSeq-1 vaccine, see WO2014042669 incorporated by reference in its entirety). In SPR assays, the transmitted/founder (T/F) Env gp120 reacted with the UCA of the CH103 lineage with a $K_D$ of ~200 nM. Studies in CH103 VH+VL knock-in mice and Rhesus macaques using EnvSeq-1 have been completed and demonstrate proof of concept that sequential CH505 gp120s can initiate bnAb B cell clonal lineages in the setting of vaccination. The EnvSeq-1 vaccine binds to CH103 precursors in CH103 bnAb knock-in mice and can expand them with immunization in adjuvant. In Rhesus macaques, the gp120 EnvSeq-1 vaccine can induce antibodies with the characteristics of precursors of CD4 binding site bnAbs. These characteristics include antibodies that differentially bind CH505 Env but not Env with an isoleucine deletion at aa 371 that disrupts the CD4 binding site, antibodies that use similar VH4 and V13 genes to the human CH103 bnAb, and antibodies that neutralize the tier 1b T/F variant CH505 4.3 as well as some tier 2 viruses.

Utility of gp120s as Sequential Envs

Whether a native trimer is needed for this purpose or if a highly antigenic Env subunit will suffice is yet unknown, but studies in mice in basic B cell biology have demonstrated that what is important for B cell survival in the germinal center (GC) is the optimal affinity of the immunogen for the GC B cell receptor (BCR)[13,14]. A key question is whether gp120 or gp140 trimers are preferred immunogens in a sequential regimen. Emerging data have demonstrated that gp120s or their fragments can engage bnAb UCAs and expand CD4bs bnAb precursors[5,15,16]. In contrast, recent data with soluble individual trimers have demonstrated that they have only induced autologous tier 2 neutralizing antibodies against glycan-bare spots and not bnAb epitopes[17,18]. Thus, it is appropriate at this time to continue to study gp120 immunogens in man to test the hypothesis that sequential immunogens can initiate bnAb lineages. Whether boosting later in the immunization sequence with a trimeric Env will be needed will be tested in future studies.

The EnvSeq-2 Sequential Vaccine from CH505 is Designed to Induce CD4 Mimicking-Type of CD4 Binding Site bnAbs In this application we propose to extend the test of sequential Env immunizations in man for initiation of broadly neutralizing antibodies to test in a human Phase I clinical trial of a new series of CH505 Envs (the EnvSeq-2 vaccine) specifically designed to induce a broader and more potent bnAb type, the CH235-like VH1-46 utilizing CD4 mimicking broad neutralizing antibody with 90% breadth and 0.6 mcg/ml inhibitory concentration 50 (IC50).

Design of a Sequential Immunogen (EnvSeq-2) to Initiate VH1-46 CD4 Mimicking CD4 Binding Site Antibody Lineages Provided herein is a new set of immunogens based on the recent work describing the sequence of events that occurred with the development of CD4 mimicking CD4 binding site bnAb lineage, CH235[12].

From this work, a natural mutant of the CH505 T/F Env called CH505.M5 was found with one amino acid difference than the CH505 T/F strain, i.e., a single N279K change, that occurred very early on after infection; M5 binds to the CH235 UCA (~0.5 micromolar)[3]. Thus, M5 is the initiating Env for CD4 mimicking CD4 binding site antibodies in the context of the EnvSeq-2 vaccine.

Next, a set of 6 mutations at amino acids 97, 275, 278, 279, 281, and 471 in the Env binding site to the CH235 lineage (FIG. 10), that were associated with escape from early CH235 antibody lineage members from autologous CH505 viruses were identified and three additional Envs chosen based on mutations at these sites.

TABLE 14

EnvSeq-2 vaccine and key amino acid mutations as well as V5 length in vaccine Env gp120 components.

| Vaccine Env | aa97 | aa275 | aa279 | aa281 | aa471 | Env V5 length |
|---|---|---|---|---|---|---|
| CH505 M5 | K | E | T | V | G | 8 |
| CH505 30.25 | K | E | T | A | G | 10 |
| CHO505 53.35 | E | E | T | G | G | 11 |
| CH505 53.29 | K | E | T | A | E | 11 |

Importantly, the later CH235 antibody lineage members acquired the ability to recognize viruses with these 6 Env mutations, presumably due to the selection imposed by exposure to the resistance mutations in vivo. These late Ch235 antibodies (such as the most potent CH235.12 antibody) had expanded breadth due to selection for recognition of these 6 mutations.

Figure 20:
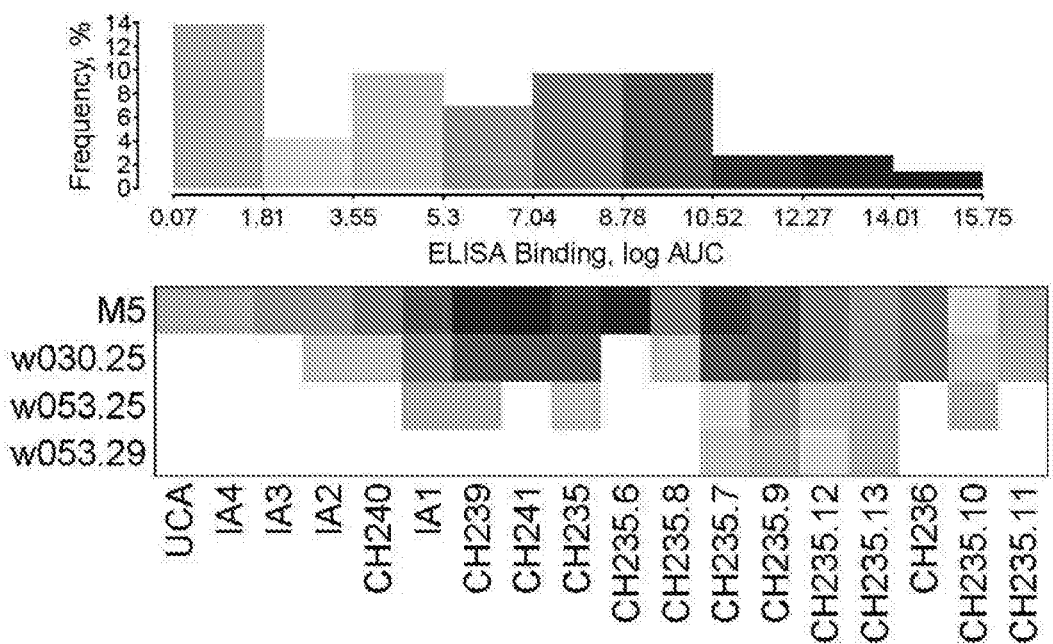
FIG. 20 shows a selection for a Sequential Vaccine. Heat Map of Binding (log Area Under the Curve, AUC) of Sequential Envs to CH235 VH1-46 type of CD4 mimic, CD4 Binding Site Broadly Neutralizing Antibody Lineage Members for sequential immunization. X axis shows CH235 antibody lineage members, from UCA to mature antibodies, from left to right.

These chosen Envs in EnvSeq-2 vaccine are not associated with the best binding of the antibodies at intermediate steps as was done for design of the EnvSeq-1 vaccine above. Rather, as the increase in breadth at in the heterologous panel coincided with a gained capacity to recognize resistance mutations, Envs were selected based on their potential to expand CH235 antibody lineage recognition in order to tolerate these 6 key and common neutralization resistance-Env mutations. Nonetheless the selected Envs indeed had capacity to sequentially bind to lineage members (FIG. 20).

Finally, the fifth hypervariable loop (V5) region length was also a strong signature for recognition of CH505 viruses by CH235 antibodies, and early lineage members could only bind and neutralize short V5s. Longer V5s were selected by the early antibodies, and later antibodies could recognize viruses with longer V5s, which are more representative of the heterologous tier 2 HIV virus population. Thus, a final key criterion for selection of sequential Envs in the EnvSeq-2 vaccine was progressive lengthening of V5 (Table 14). Thus, the EnvSeq-2 Envs are associated with development of heterologous breadth from the CH235 UCA→CH235→CH235.9→CH235.12.

The EnvSeq-2 set of immunogens are currently begin produced in non-GMP in pre-production runs, and during year 1 of the Staged Vaccine Contract, will be tested in vitro in recombinant protein immunizations in both VH+VL humanized mice and rhesus macaques. In addition, a second set of CH505 immunogens chosen based on affinity of binding to members of the CH235 antibody lineage will be tested in similar immunization studies (a vaccine called EnvSeq-3, FIG. 21).

The optimal immunogen of the two sets of sequential Envs following comparison of EnvSeq-2 versus EnvSeq-3 will be chosen for GMP production in preclinical studies based on the following criteria:
a) highest level of induction of memory B cell antibodies that bind to CH505 Env and do not bind to CH505 Env with an isoleucine deletion at amino acid position 371 that disrupts the CD4 binding site (called "differential binding" memory B cells),
b) no neutralization of the tier 2 CH505 T/F virus (the CH235 UCA does not neutralize the CH505 tier 2 TF virus. However, if the induced antibodies do neutralize the tier 2 TF CH505 virus, then it will be an indication of immunogen driving a CH235 lineage further into lineage maturation).
c) highest level of neutralization of the tier 1b CH505 T/F variant 4.3,
d) highest level of heterologous primary HIV strain neutralizing antibodies induced.

Figure 21:
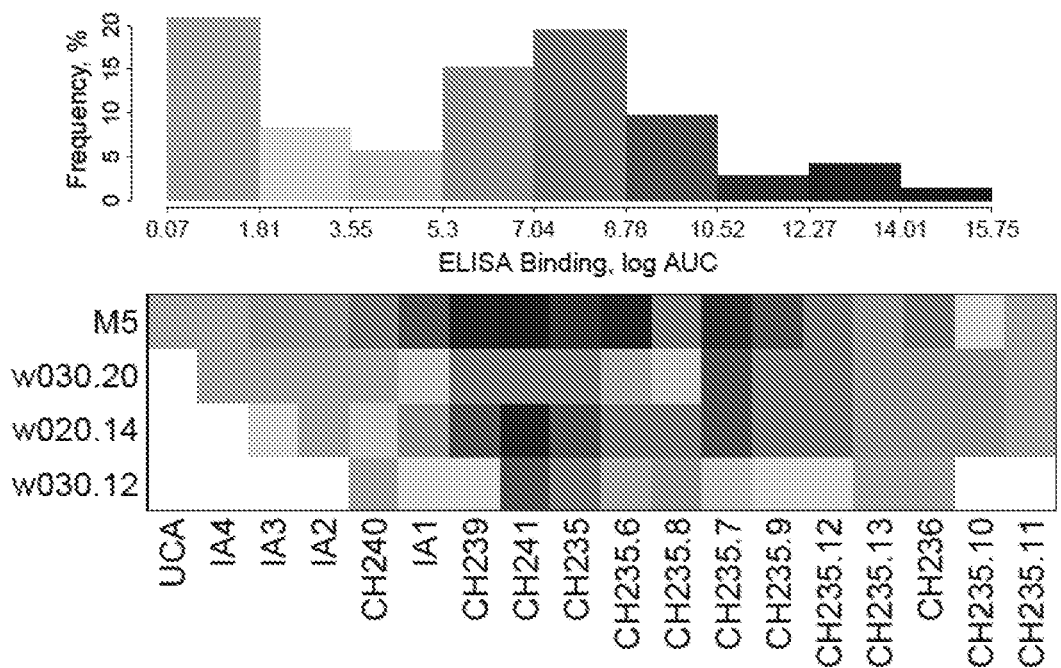
FIG. 21 shows a selection for a Sequential Vaccine. Heat Map of Binding (log Area Under the Curve, AUC) of Sequential Envs to CH235 VH1-46 type of CD4 mimic, CD4 Binding Site Broadly Neutralizing Antibody Lineage Members for sequential immunization.

In summary, provided are two selections of CH505 envelopes—FIG. 20 (EnvSeq-2) or FIG. 21 (EnvSeq-3)—for use in immunization regimens. In some embodiments these are used as recombinant CH505 Env gp120s (including gp120 delta N)), to be used in sequence following the administration of the CH505 M5 priming Env that binds to the CH235 UCA. In other embodiments these are used in any other suitable form, for example but not limited to stable SOSIP trimer designs, gp145s, gp140s, both cleaved and uncleaved, gp140 Envs with the deletion of the cleavage (C) site, fusion (F) and immunodominant (I) region in gp41—named as gp140ΔCFI (g140CFI), gp140 Envs with the deletion of only the cleavage (C) site and fusion (F) domain—named as gp140ΔCF (gp140CF), gp140 Envs with the deletion of only the cleavage (C)—named gp140ΔC (gp140C) (See e.g. Liao et al. Virology 2006, 353, 268-282), gp150s, gp41s, which are readily derived from the nucleic acid and amino acid gp160 sequences.

References for Example 6a

1 Mascola, J. R. & Haynes, B. F. HIV-1 neutralizing antibodies: understanding nature's pathways. *Immunological reviews* 254, 225-244, doi:10.1111/imr.12075 (2013).
2 Haynes, B. F., Kelsoe, G., Harrison, S. C. & Kepler, T. B. B-cell-lineage immunogen design in vaccine development with HIV-1 as a case study. *Nature biotechnology* 30, 423-433, doi:10.1038/nbt.2197 (2012).
3 Haynes, B. F. & Verkoczy, L. AIDS/HIV. Host controls of HIV neutralizing antibodies. *Science* 344, 588-589, doi: 10.1126/science.1254990 (2014).
4 Jardine, J. et al. Rational HIV immunogen design to target specific germline B cell receptors. *Science* 340, 711-716, doi:10.1126/science.1234150 (2013).
5 McGuire, A. T. et al. Engineering HIV envelope protein to activate germline B cell receptors of broadly neutralizing anti-CD4 binding site antibodies. *The Journal of experimental medicine* 210, 655-663, doi:10.1084/jem.20122824 (2013).
6 Morris, L. et al. Isolation of a human anti-HIV gp41 membrane proximal region neutralizing antibody by antigen-specific single B cell sorting. *PloS one* 6, e23532, doi:10.1371/journal.pone.0023532 (2011).
7 Zhou, T. et al. Structural Repertoire of HIV-1-Neutralizing Antibodies Targeting the CD4 Supersite in 14 Donors. *Cell* 161, 1280-1292, doi:10.1016/j.cell.2015.05.007 (2015).
8 Bonsignori, M. et al. Analysis of a clonal lineage of HIV-1 envelope V2/V3 conformational epitope-specific broadly neutralizing antibodies and their inferred unmutated common ancestors. *Journal of virology* 85, 9998-10009, doi: 10.1128/JVI.05045-11 (2011).
9 Andrabi, R. et al. Identification of Common Features in Prototype Broadly Neutralizing Antibodies to HIV Envelope V2 Apex to Facilitate Vaccine Design. *Immunity* 43, 959-973, doi:10.1016/j.immuni.2015.10.014 (2015).
10 Gorman, J. et al. Structures of HIV-1 Env V1V2 with broadly neutralizing antibodies reveal commonalities that enable vaccine design. *Nature structural & molecular biology* 23, 81-90, doi:10.1038/nsmb.3144 (2016).
11 Liao, H. X. et al. Co-evolution of a broadly neutralizing HIV-1 antibody and founder virus. *Nature* 496, 469-476, doi:10.1038/nature12053 (2013).

12 Bonsignori, M. et al. Maturation Pathway from Germline to Broad HIV-1 Neutralizer of a CD4-Mimic Antibody. *Cell* 165, 449-463, doi:10.1016/j.cell.2016.02.022 (2016).
13 Dal Porto, J. M., Haberman, A. M., Kelsoe, G. & Shlomchik, M. J. Very low affinity B cells form germinal centers, become memory B cells, and participate in secondary immune responses when higher affinity competition is reduced. *The Journal of experimental medicine* 195, 1215-1221 (2002).
14 Shih, T. A., Meffre, E., Roederer, M. & Nussenzweig, M. C. Role of BCR affinity in T cell dependent antibody responses in vivo. *Nature immunology* 3, 570-575, doi:10.1038/ni803 (2002).
15 McGuire, A. T. et al. Specifically modified Env immunogens activate B-cell precursors of broadly neutralizing HIV-1 antibodies in transgenic mice. *Nature communications* 7, 10618, doi:10.1038/ncomms10618 (2016).
16 Jardine, J. G. et al. HIV-1 broadly neutralizing antibody precursor B cells revealed by germline-targeting immunogen. *Science* 351, 1458-1463, doi:10.1126/science.aad9195 (2016).
17 Sanders, R. W. et al. HIV-1 VACCINES. HIV-1 neutralizing antibodies induced by native-like envelope trimers. *Science* 349, aac4223, doi:10.1126/science.aac4223 (2015).
18 Bradley, T. et al. Structural Constraints of Vaccine-Induced Tier-2 Autologous HIV Neutralizing Antibodies Targeting the Receptor-Binding Site. *Cell reports* 14, 43-54, doi:10.1016/j.celrep.2015.12.017 (2016).

Example 6B: Vaccine Antigen Design Based on the Evolution of Breadth of the CH235 bNAb Lineage Four CH505 Vaccine Candidates Based on the Evolution of Breadth of the CH235 Lineage, Targeting the CD4bs The mutant called CH505.M5 is the starting point for identifying CH505 vaccine candidates. CH505.M5 is one amino acid different than the CH505 TF strain, with a single N279K change, that occurred very early and conferred resistance to the cooperating CH103 lineages.

Identification of Signature Sites in the Contact Surface of the Antibody (<8.5 A)

Mutational patterns in the signature sites in the contact surface of the antibody are determined (in the global Tier II panel, as well as in our subjects). These sites are related to heterologous and autologous neutralization sensitivity/resistance signatures. The pattern of critical interest is the set of mutations (in this case, 6 positions with mutations that are common in the circulating population) that were associated with a high degree of resistance in the heterologous population to early CH235 lineage members, but that were less restrictive for late lineage members. These amino acids were also associated with a high degree of resistance to early antibodies among CH505's Envs, and so escape in the autologous population. Later lineage members acquired the ability to recognize these mutations, presumably due to the selection imposed by exposure to the resistance mutations in vivo. These late antibodies then had expanded breadth at the population level, presumably due to selection for recognition of these mutations.

These amino acids are not associated with the best binding of the antibodies at intermediate steps (earlier hypotheses for selecting Envs was to simply pick those that bound best to intermediate linage members). As the increase in breadth in the heterologous panel coincides with a gained capacity to recognize resistance mutations, Envs are picked based on their potential to expand Ab recognition to tolerate common resistance mutations and also to require Envs that had at least some capacity to bind to lineage members, but placing emphasis on covering common signatures, not on highest binders.

Hypervariable V5 region length was also a strong signature for recognition, and early lineage members could only see short V5's. Longer V5s were selected by the early antibodies, and later antibodies could recognize viruses with longer V5s, which are more representative of the heterologous population.

The mutations conferring viral escape (or relative resistance) from early lineage antibodies are educating the later antibodies.

Later antibodies in the lineage gain breadth at the population level because they evolved the capacity to recognize particular resistance conferring amino acids that arose in vivo.

Figure 35:
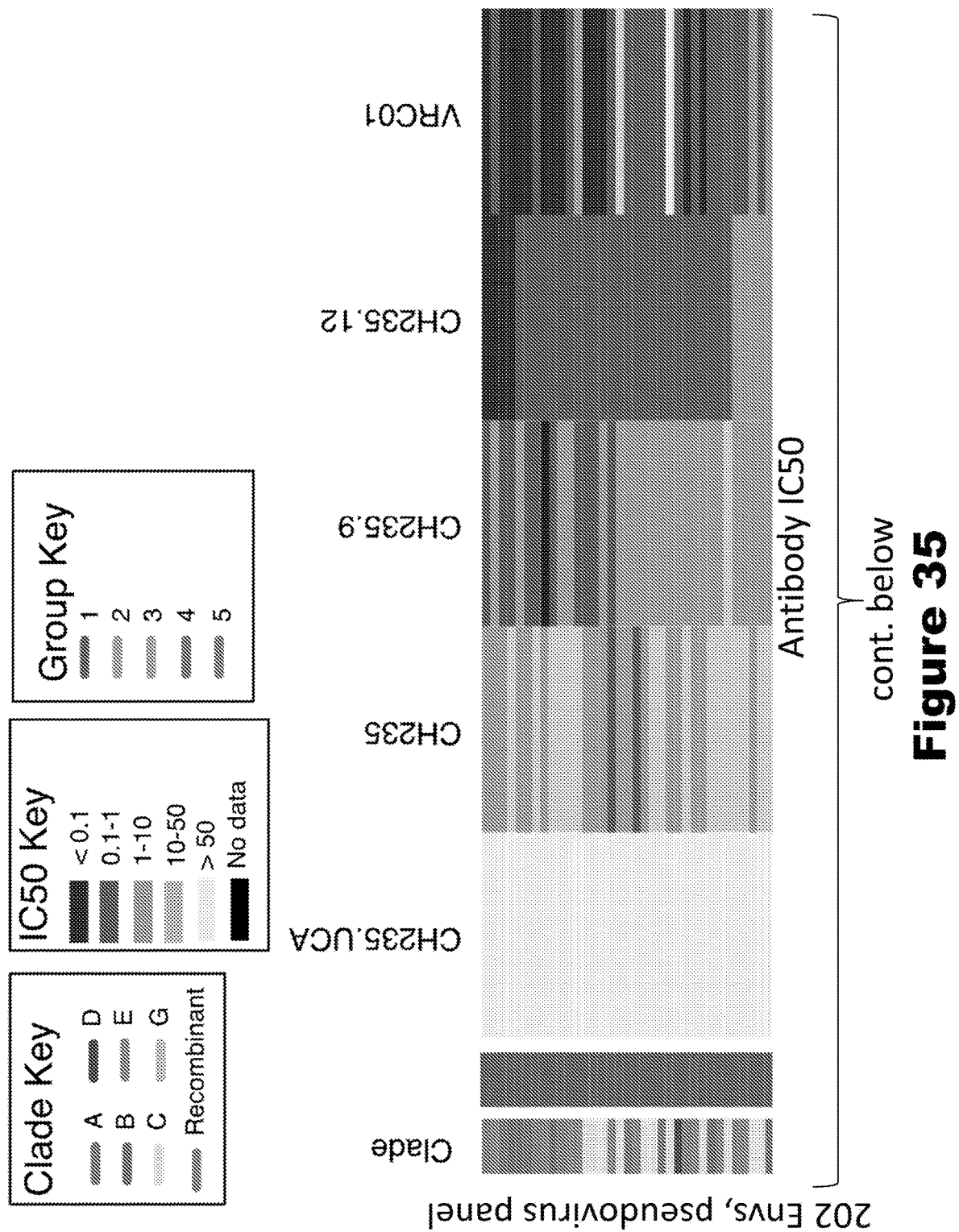
FIG. 35 shows a heterologous panel heatmap of IC50s.
Figure 35:
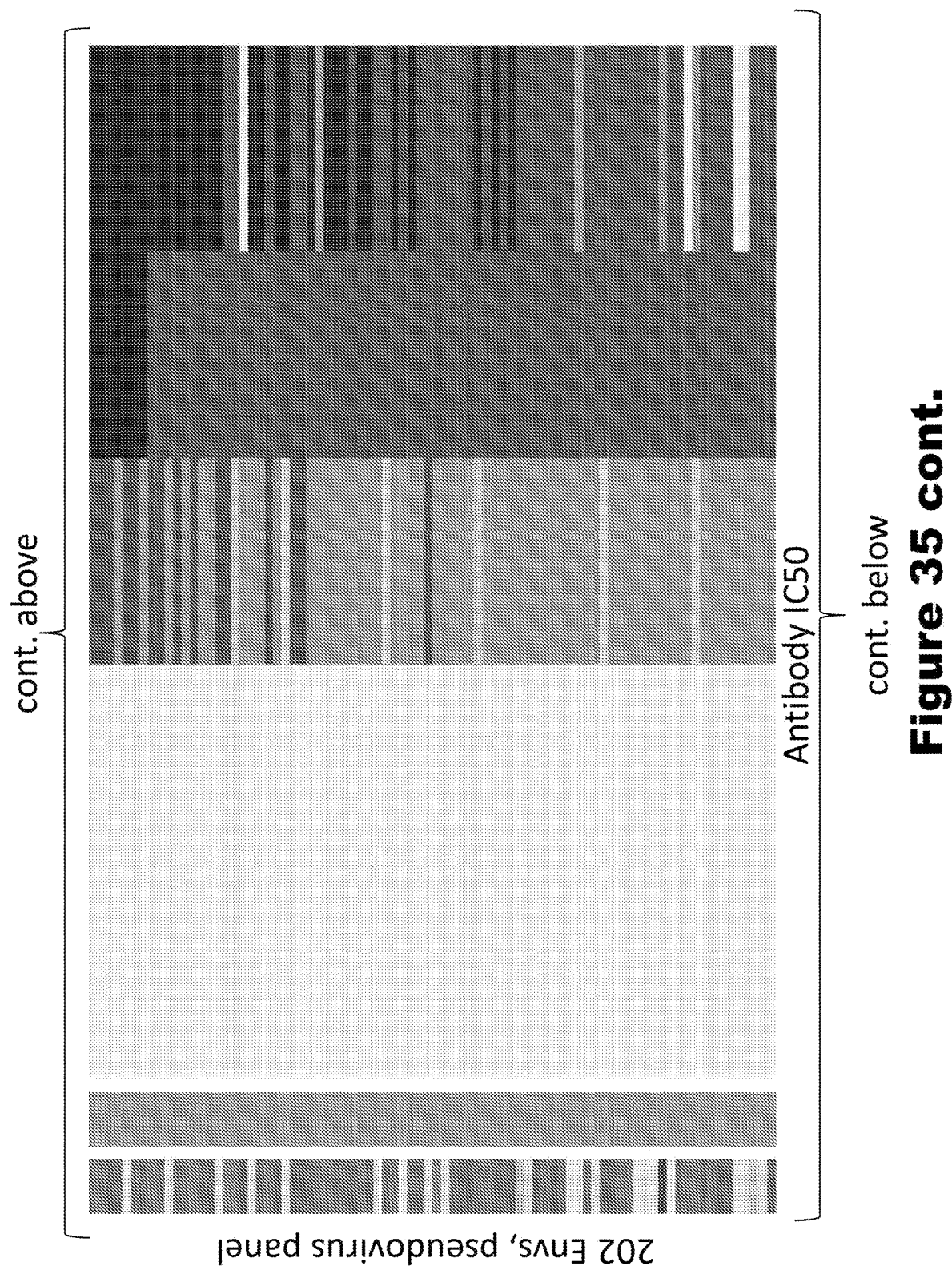
Figure 35:
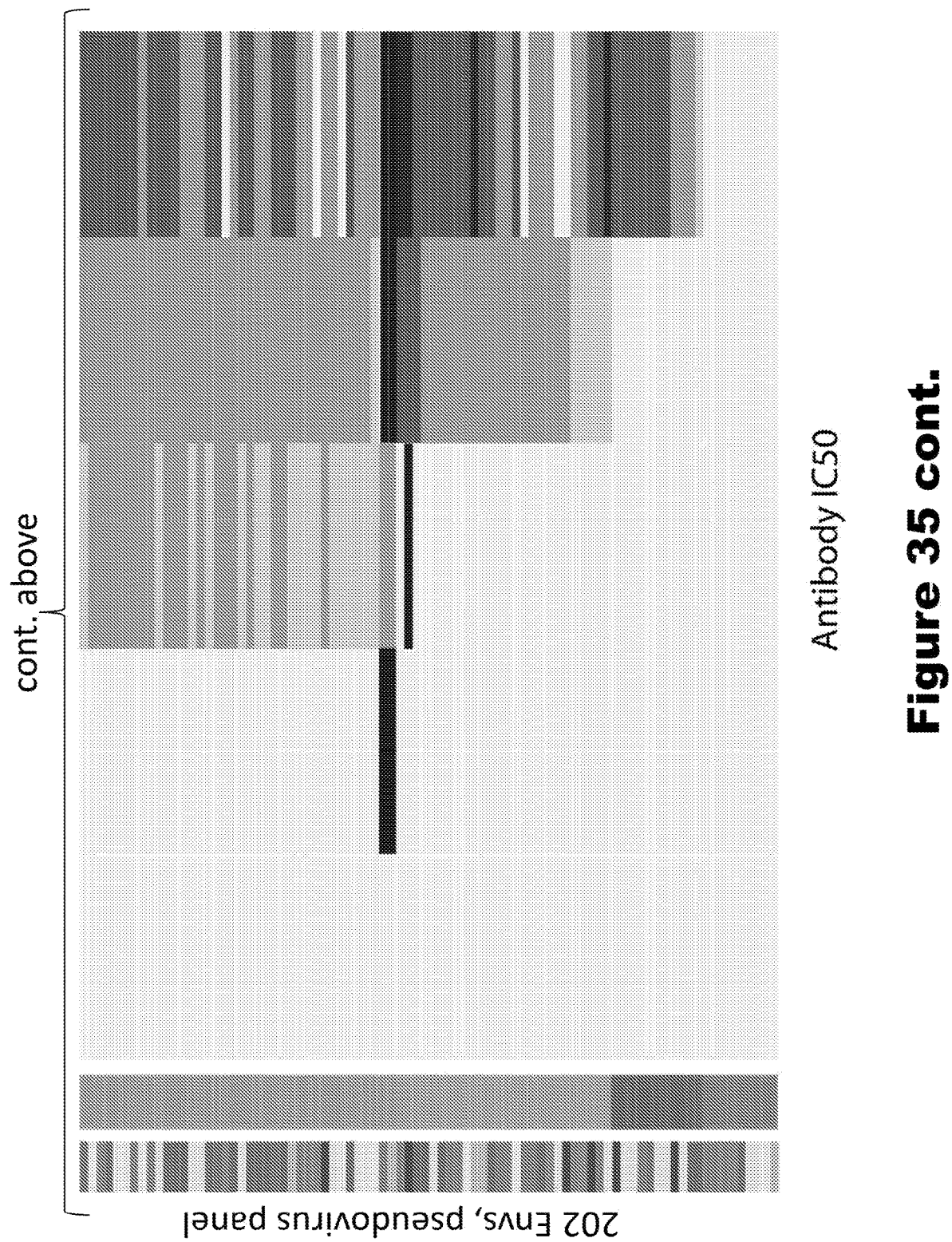

Envs that are associated with jump in breadth from the UCA→CH235→CH235.9→CH235.12 are defined. The amino acids that are statistically most closely associated with distinct increases in breadth, the heterologous signatures, are identified. These signatures are related back to cycles of escape/recognition in vivo—exposure to these signature amino acids seems to trigger the increase breadth. FIG. 35 shows the heterologous panel heatmap of IC50s for CH235UCA, CH235, CH235.9, CH235.12, and VRC01 for 202 Envs.

Figure 36:
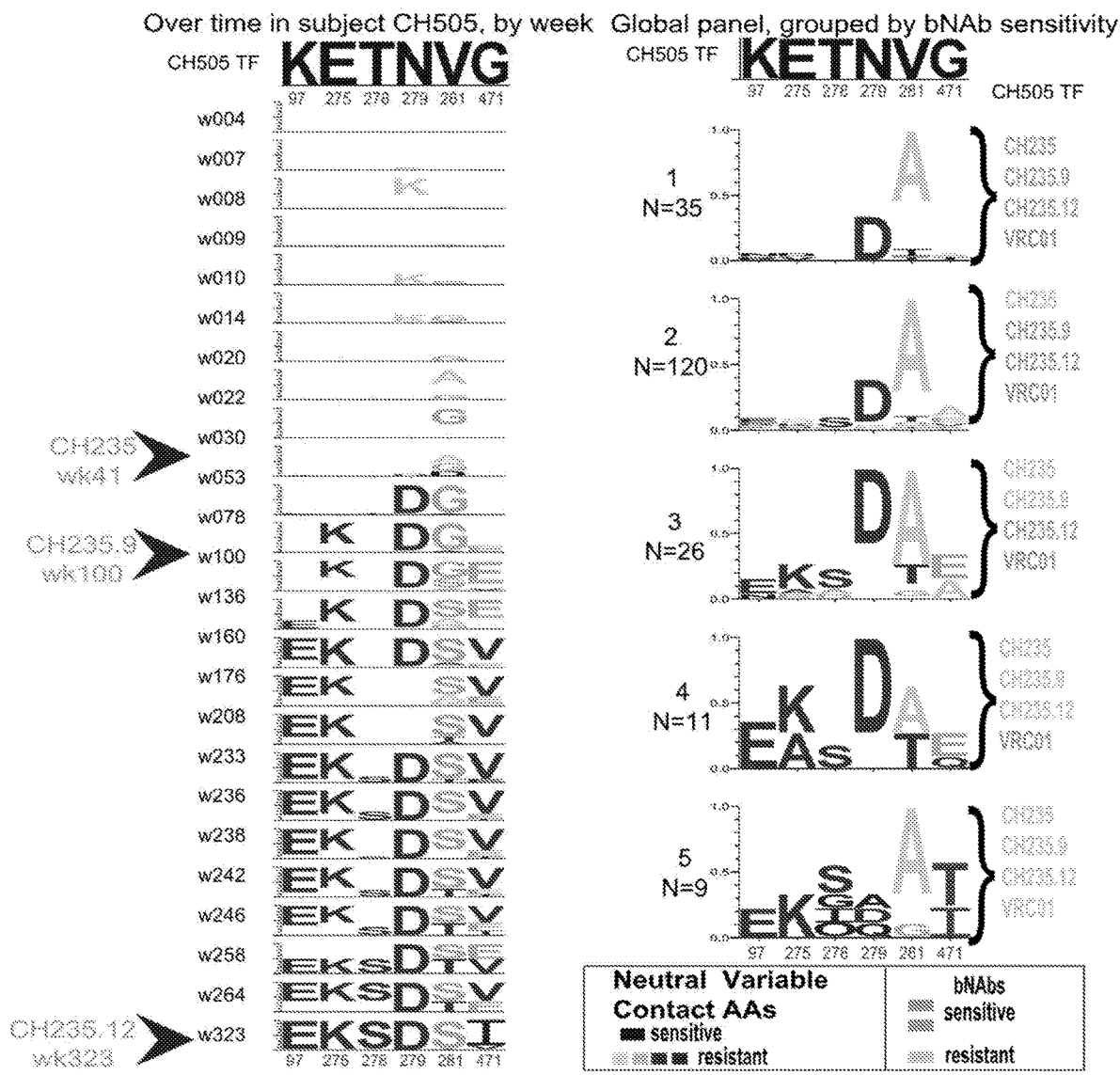
FIG. 36 shows the global panel, grouped by bNAb sensitivity (right panel). Env mutations over time in subject CH505, by week is shown in the left panel.
Figure 37:
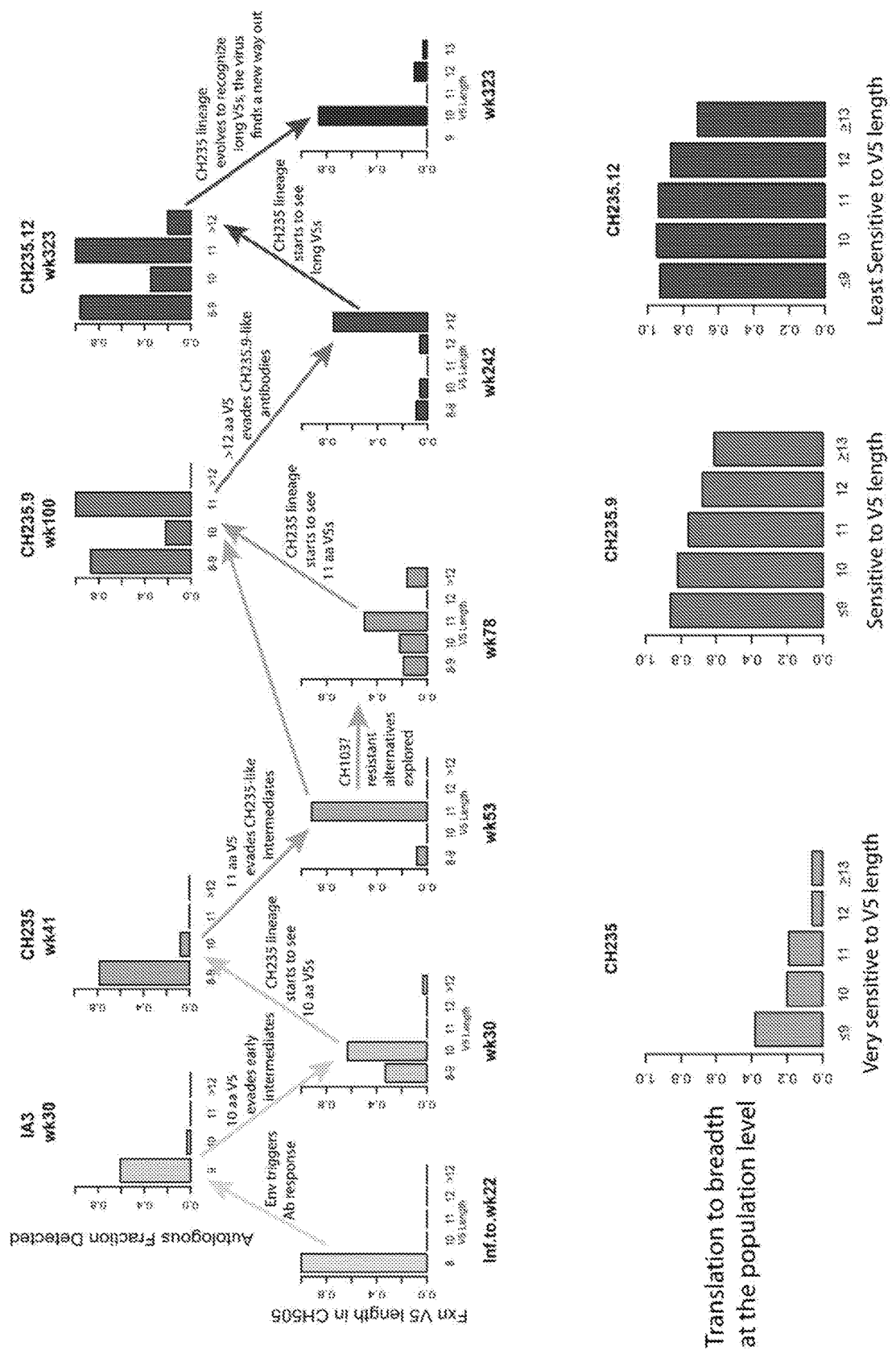
FIG. 37 shows V5 selection yields population breadth.

Mutations that are common in the circulating population and are heterologous signatures are shown on the right of FIG. 36. The 207 M group panel is grouped by bNAb sensitivity—antibodies marked with an asterisk are sensitive. Selected based only on CH235 lineage signatures at the population level, the env mutations in subject CH505 are shown in the left of FIG. 36. These contact signature amino acids are enriched among viruses that are resistance to CH235 and CH235.9, and sensitive to CH235.12.

Envs from CH505 that carried the signature mutations were picked, requiring at least some binding of later antibodies to the antigens and that they carried modest increases in V5 length relative to M5 (FIG. 38). M5 was the best trigger for CH235 like antibodies. Env30.25 gave a gentle nudge towards the most common mutations at the population level, where CH505 TF differed from consensus. An increase in V5 length is present. Env53.25 increase the V5 length, and adds three other relatively common mutations. Env 53.29 adds 471E, that may inhibit CH235.9 binding, but CH235.12 can recognized viruses with 471E. None of the CH235 Envs tested with the E275K mutation bound any of the CH235 lineages, they were not included in the set. As there is no binding data, T278S comes up too late be included in the set.

Figure 39:
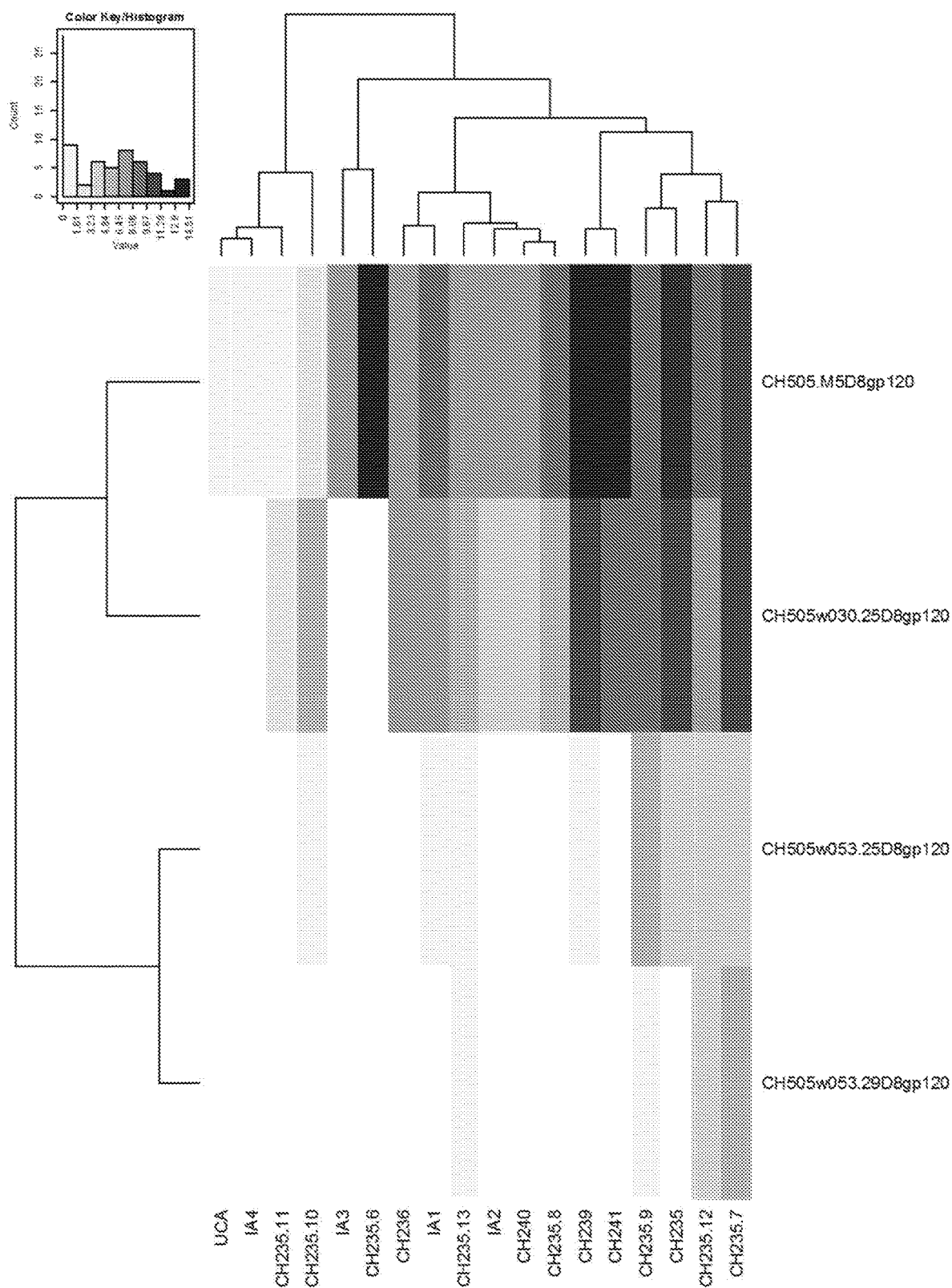
FIG. 39 shows a selection of four envelopes from CH505 and their binding to CH235 lineage antibodies.

Although CH235.12 binds Envs that carry K97E and G471E with low affinity, the differential capacity to recognize heterologous Envs between CH235.9 and CH235.12 is very strongly associated with CH235.12's ability to recognize Envs that have an E in either one of those 2 positions, so including them here may enable selection of antibodies that can recognize these quite common mutations at the population level, that restrict CH235's early lineage member's breadth (FIG. 39).

Figure 40:
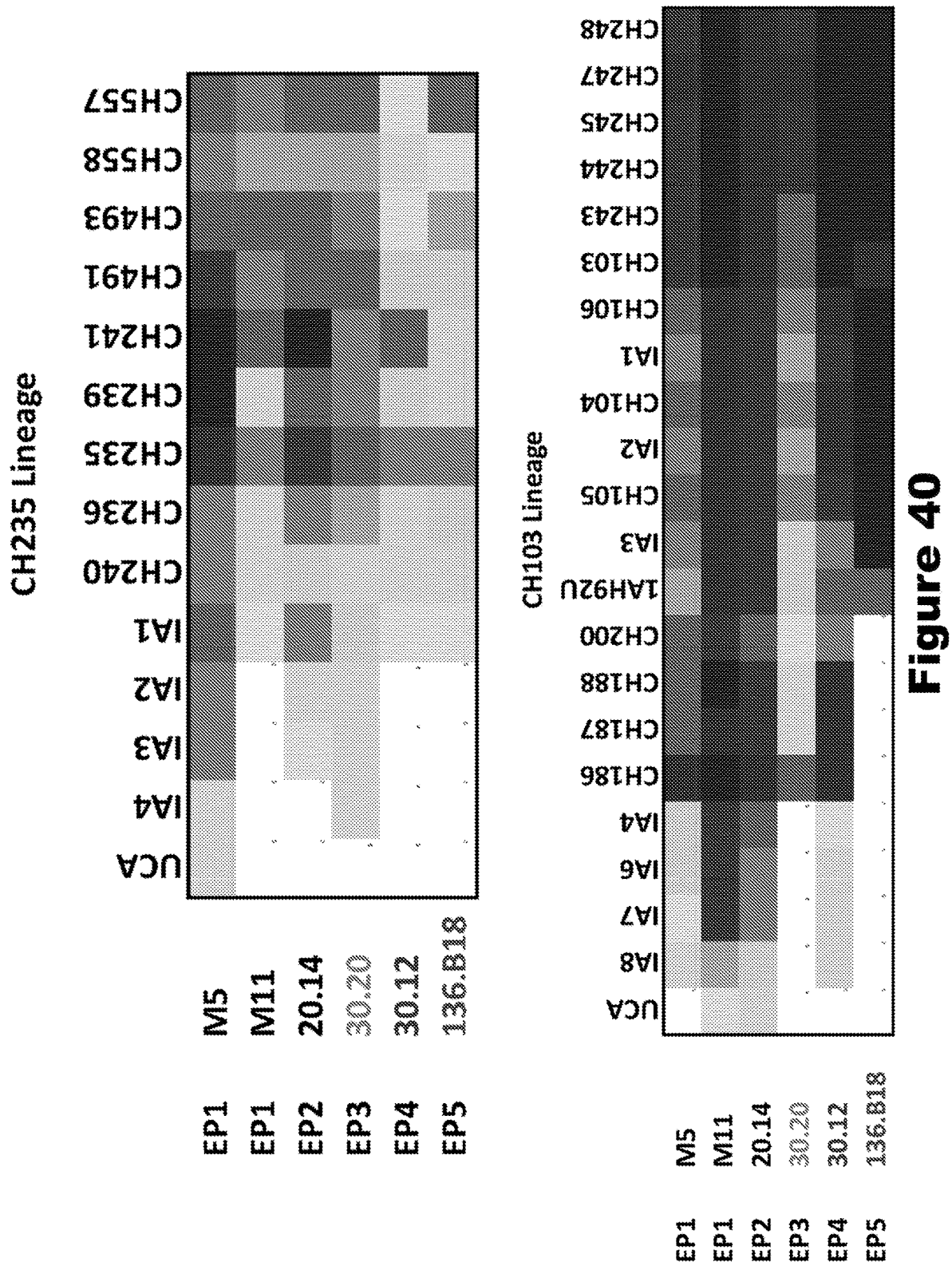
FIG. 40 shows a selection of CH505 immunogens to drive both CH103 and CH235 CD4 binding site types of broad neutralizing B cell lineages.

A main difference between the choice of CH505 immunogens in FIG. 40 (Selection F) and Selection G is in signature position 97 and 471. These are invariant among these six strains, with K97 and G471. But each has an E among the antigens selected on FIG. 38.

Example 7: Animal Studies

The immunogens of the invention, for example Selection F (M5, M11, 20.14, 30.20, 30.12, 136.B18) could be tested in any suitable non-human animal model. Immune responses, including B cell and T cell responses to the vaccine, could be measured by any suitable assay and criteria, such as but non limited plasma neutralization, plasma binding to vaccine and/or heterologous envelopes and/or viruses could be measured. Animals studies with various forms of the selected immunogens are contemplated: gp160 mRNA of M5, M11, 20.14, 30.20, 30.12, 136.B18 (NHP #141), 6-valent M5, M11, 20.14, 30.20, 30.12, 136.B18 as SOSIP trimers (NHP #142), mRNA of 6-valent stabilized SOSIP trimers of M5, M11, 20.14, 30.20, 30.12, 136.B18 (NHP #140), gp145DNA of CH505M5 and CH505M11 as a prime and a subsequence boost(s), followed by 6-valent M5, M11, 20.14, 30.20, 30.12, 136.B18 SOSIP trimers (e.g. NHP #139). In some embodiments the SOSIP trimer is SOSIP v4.1. Any other trimer design is contemplated. Any suitable adjuvant could be used. Studies could be performed in any suitable animal model. Studies could be performed in adults and neonates.

TABLE 15

NHP Study #139: gp145 DNA M5 + M11(×2) + 6-valent 4.1 SOSIP in neonates.

| Bleed Date | Receive @ BIDMC | Instructions (I.D. Immunizations) | Samples Qty/Volume Needed | Done at receiving laboratory |
|---|---|---|---|---|
| Wk 0 | Wk 0 **Prebleed Processed at Bioqual | Bleed + Immunize neonates only: M5 gp 145 DNA (2 mg) + M11 gp 145 DNA (2 mg) IM | EDTA+ + Stool + Rectal swabs + saliva + IDEXX serum chems + CBC | Freeze plasma in 250 uL aliquots *Bioqual to freeze Wk 0 samples |
| Wk 2 | Wk 2 | Bleed all animals | EDTA+ + Stool + Rectal swabs + saliva + IDEXX serum chems + CBC | Freeze plasma in 250 uL aliquots |
| Wk 4 | Wk 4 | Immunize neonates only: M5 gp 145 DNA (2 mg) + M11 gp 145 DNA (2 mg) IM | Stool + Rectal swabs + saliva | |
| Wk 6 | Wk 6 | Bleed all animals | EDTA+ + Stool + Rectal swabs + saliva + IDEXX serum chems + CBC | Freeze plasma in 250 uL aliquots; all PBMCs |
| Wk 8 | Wk 8 | Immunize neonates only: M5 SOSIP 4.1 stable trimer (25 ug) + M11 SOSIP 4.1 stable trimer (25 ug) In Poly ICLC (Hiltonol) = 200 ug IM | Stool + Rectal swabs + saliva | |
| Wk 10 | Wk 10 | Bleed all animals | EDTA+ + Stool + Rectal swabs + saliva + IDEXX serum chems + CBC | Freeze plasma in 250 uL aliquots; all PBMCs |
| Wk 12 | Wk 12 | Immunize neonates only: 20.14 SOSIP 4.1 stable trimer (50 ug) In Poly ICLC (Hiltonol) = 200 ug IM | Stool + Rectal swabs + saliva | |
| Wk 14 | Wk 14 | Bleed all animals | EDTA + SST + Stool + Rectal swabs + saliva + IDEXX serum chems + CBC | Freeze serum and plasma in 250 uL aliquots; all PBMCs |
| Wk 16 | Wk 16 | Immunize neonates only: 30.20 SOSIP 4.1 stable trimer (50 ug) In Poly ICLC (Hiltonol) = 200 ug IM | Stool + Rectal swabs + saliva | |
| Wk 18 | Wk 18 | Bleed all animals | EDTA + SST + Stool + Rectal swabs + saliva + IDEXX serum chems + CBC | Freeze serum and plasma in 250 uL aliquots; all PBMCs |
| Wk 20 | Wk 20 | Immunize neonates only: 30.12 SOSIP 4.1 stable trimer In Poly ICLC (Hiltonol) = 200 ug IM | Stool + Rectal swabs + saliva | |

TABLE 15-continued

NHP Study #139: gp145 DNA M5 + M11(×2) + 6-valent 4.1 SOSIP in neonates.

| Bleed Date | Receive @ BIDMC | Instructions (I.D. Immunizations) | Samples Qty/Volume Needed | Done at receiving laboratory |
|---|---|---|---|---|
| Wk 22 | Wk 22 | Bleed all animals | EDTA + SST + Stool + Rectal swabs + saliva + IDEXX serum chems + CBC | Freeze serum and plasma in 250 uL aliquots |
| Wk 24 | Wk 24 | Immunize neonates only: 136.B8 SOSIP 4.1 stable trimer In Poly ICLC (Hiltonol) = 200 ug IM | Stool + Rectal swabs + saliva | |
| Wk 26 | Wk 26 | Bleed all animals | EDTA + SST + Stool + Rectal swabs + saliva + IDEXX serum chems + CBC | Freeze serum and plasma in 250 uL aliquots |

TABLE 16

NHP study #140: mRNA 6-valent chimeric stabilized 4.1 trimers

| Bleed Date | Receive @ BIDMC | Instructions (I.D. Immunizations) | Samples Qty/Volume Needed | Done at BIDMC |
|---|---|---|---|---|
| Pre-bleed Feb. 22, 2017 | Pre-bleed Feb. 23, 2017 | Pre-LN biopsy (axillary) Pre-Bleed all animals NHP's: 150796, 150798, 150794, 150252 | 6 ml EDTA + 2 ml SST + serum chemistry (IDEXX) + CBC (IDEXX) | Freeze Plasma and serum in 250 uL aliquots; all PBMC |
| Wk 0 Feb. 28, 2017 | Wk 0 Feb. 29, 2017 | Bleed all animals and immunize: M5 chimeric stabilized trimer (kos) mRNA-LNP 50 ug + M11 chimeric stabilized trimer (kos) mRNA-LNP 50 ug ID = 10 sites on the back Give M5 and M11 separately at different sites to avoid heterotrimers mRNA-LNPs: *diluted in calcium and magnesium free PBS where needed. *once thawed are stored on ice and administered within 2 hours NHP's: 150796, 150798, 150794, 150252 | No sampling | No sampling |
| Wk 1 Mar. 7, 2017 | Wk 1 Mar. 8, 2017 | Bleed all animals LN biopsy (inguinal) | 6 ml EDTA + 2 ml SST + serum chemistry (IDEXX) + CBC (IDEXX) | Freeze Plasma and serum in 250 uL aliquots; all PBMC |
| Wk 2 Mar. 14, 2017 | Wk 2 Mar. 15, 2017 | Bleed all animals | 6 ml EDTA + 2 ml SST + serum chemistry (IDEXX) + CBC (IDEXX) | Freeze serum and plasma in 250 uL aliquots; all PBMCs |
| Wk 4 Mar. 29, 2017 | Wk 4 Mar. 30, 2017 | Bleed all animals and immunize: 20.14 chimeric stabilized trimer (kos) mRNA-LNP 50 ug ID = 10 sites on the back | 6 ml EDTA + 2 ml SST + serum chemistry (IDEXX) + CBC (IDEXX) | Freeze serum and plasma in 250 uL aliquots; all PBMCs |
| Wk 5 Apr. 5, 2017 | Wk 5 Apr. 6, 2017 | Bleed all animals LN biopsy (inguinal) | 6 ml EDTA + 2 ml SST + serum chemistry (IDEXX) + CBC (IDEXX) | Freeze serum and plasma in 250 uL aliquots; all PBMCs |

TABLE 16-continued

NHP study #140: mRNA 6-valent chimeric stabilized 4.1 trimers

| Bleed Date | Receive @ BIDMC | Instructions (I.D. Immunizations) | Samples Qty/Volume Needed | Done at BIDMC |
|---|---|---|---|---|
| Wk 6 Apr. 12, 2017 | Wk 6 Apr. 13, 2017 | Bleed all animals | 6 ml EDTA + 2 ml SST + serum chemistry (IDEXX) + CBC (IDEXX) | Freeze serum and plasma in 250 uL aliquots; all PBMCs |
| Wk 8 Apr. 26, 2017 | Wk 8 Apr. 27, 2017 | Bleed all animals and immunize: 30.20 chimeric stabilized trimer (kos) mRNA-LNP 50 ng ID = 10 sites on the back | 6 ml EDTA + 2 ml SST + serum chemistry (IDEXX) + CBC (IDEXX) | Freeze serum and plasma in 250 uL aliquots; all PBMCs |
| Wk 9 May 3, 2017 | Wk 9 May 4, 2017 | Bleed all animals | 6 ml EDTA + 2 ml SST + serum chemistry (IDEXX) + CBC (IDEXX) | Freeze serum and plasma in 250 uL aliquots; all PBMCs |
| Wk 10 May 10, 2017 | Wk 10 May 11, 2017 | Bleed all animals | 6 ml EDTA + 2 ml SST + serum chemistry (IDEXX) + CBC (IDEXX) | Freeze serum and plasma in 250 uL aliquots; all PBMCs |
| Wk 12 May 24, 2017 | Wk 12 May 25, 2017 | Bleed all animals and immunize: 30.12 chimeric stabilized trimer (kos) mRNA-LNP 50 ug ID = 10 sites on the back | 6 ml EDTA + 2 ml SST + serum chemistry (IDEXX) + CBC (IDEXX) | Freeze serum and plasma in 250 uL aliquots; all PBMCs |
| Wk 13 May 31, 2017 | Wk 13 Jun. 1, 2017 | Bleed all animals | 6 ml EDTA + 2 ml SST + serum chemistry (IDEXX) + CBC (IDEXX) | Freeze serum and plasma in 250 uL aliquots; all PBMCs |
| Wk 14 Jun. 7, 2017 | Wk 14 Jun. 8, 2017 | Bleed all animals | 6 ml EDTA + 2 ml SST + serum chemistry (IDEXX) + CBC (IDEXX) | Freeze serum and plasma in 250 uL aliquots; all PBMCs |
| Wk 16 Jun. 21, 2017 | Wk 16 Jun. 22, 2017 | Bleed all animals and immunize: 136.B18 chimeric stabilized trimer (kos) mRNA-LNP 50 ug ID = 10 sites on the back | 6 ml EDTA + 2 ml SST + serum chemistry (IDEXX) + CBC (IDEXX) | Freeze serum and plasma in 250 uL aliquots; all PBMCs |
| Wk 17 Jun. 28, 2017 | Wk 17 Jun. 29, 2017 | Bleed all animals LN biopsy (axillary) | 6 ml EDTA + 2 ml SST + serum chemistry (IDEXX) + CBC (IDEXX) | Freeze serum and plasma in 250 uL aliquots; all PBMCs |
| Wk 18 Jul. 5, 2017 | Wk 18 Jul. 6, 2017 | Bleed all animals | 6 ml EDTA + 2 ml SST + serum chemistry (IDEXX) + CBC (IDEXX) | Freeze serum and plasma in 250 uL aliquots; all PBMCs |
| Wk 20 Jul. 19, 2017 | Wk 20 Jul. 20, 2017 | Bleed all animals | 6 ml EDTA + 2 ml SST + serum chemistry (IDEXX) + CBC (IDEXX) | Freeze serum and plasma in 250 uL aliquots; all PBMCs |
| Wk 24 Aug. 2, 2017 | Wk 24 Aug. 3, 2017 | Bleed all animals | 6 ml EDTA + 2 ml SST + serum chemistry (IDEXX) + CBC (IDEXX) | Freeze serum and plasma in 250 uL aliquots; all PBMCs |

TABLE 16-continued

NHP study #140: mRNA 6-valent chimeric stabilized 4.1 trimers

| Bleed Date | Receive @ BIDMC | Instructions (I.D. Immunizations) | Samples Qty/Volume Needed | Done at BIDMC |
|---|---|---|---|---|
| Wk 28 Aug. 16, 2017 | Wk 28 Aug. 17, 2017 | Bleed all animals | 6 ml EDTA + 2 ml SST + serum chemistry (IDEXX) + CBC (IDEXX) | Freeze serum and plasma in 250 uL aliquots; all PBMCs |

In any of the methods of the invention, the mRNA immunogens are delivered by a lipid nanoparticle (LNP) technology. The LNPs comprises four different lipids that could self assemble to 80-100 nm size particles.

TABLE 17

NHP Study #141: mRNA 6-valent gp 160 membrane bound trimers

| Bleed Date | Receive @ BIDMC | Instructions (I.D. Immunizations) | Samples Qty/Volume Needed | Done at receiving laboratory |
|---|---|---|---|---|
| Wk 0 Nov. 9, 2016 | Wk 0 Nov. 10, 2016 | Pre-LN biopsy (axillary) Immunize all 4 animals: 4 NHPs (4 NOTchallenged monkeys from #129 vaccinated): 6858(M), 150250(F), 150793(M), 150795(M) M5 gp 160 membrane bound trimer mRNA-LNP 50 ug + M11 gp 160 membrane bound trimer mRNA-LNP 50 ug ID = 60 ul × 10 sites on the back Give M5 and M11 separately at different sites to avoid heterotrimers mRNA-LNPs: *diluted in calcium and magnesium free PBS where needed. *once thawed are stored on ice and administered within 2 hours | Pre-LN biopsy (axillary 4 ml EDTA + 2 ml SST | Freeze serum and plasma in 250 uL aliquots |
| Wk 1 Nov. 16, 2016 | Wk 1 Nov. 17, 2016 | Bleed all animals + Draining lymph node biopsies (axillary) | 2 ml EDTA + Draining lymph node biopsies (axillary) | Freeze plasma in 250 uL aliquots |
| Wk 2 Nov. 21, 2016 | Wk 2 Nov. 22, 2016 | Bleed all animals | 6 ml EDTA + 2 ml SST | Freeze serum and plasma in 250 uL aliquots; all PBMCs |
| Wk 4 Dec. 6, 2016 | Wk 4 Dec. 7, 2016 | Bleed all animals and immunize: 20.14 gp 160 membrane bound trimer mRNA-LNP 50 ug ID = 60 ul × 10 sites on the back | 4 ml EDTA + 2 ml SST | Freeze serum and plasma in 250 uL aliquots |
| Wk 5 Dec. 13, 2016 | Wk 5 Dec. 14, 2016 | Bleed all animals + Draining lymph node biopsies (inguinal) | 3 ml EDTA + Draining lymph node biopsies (inguinal) | Freeze serum and plasma in 250 uL aliquots; all PBMCs |
| Wk 6 Dec. 20, 2016 | Wk 6 Dec. 21, 2016 | Bleed all animals | 3 ml EDTA + 2 ml SST | Freeze serum and plasma in 250 uL aliquots; all PBMCs |
| Wk 7 Dec. 27, 2016 | Wk 7 Dec. 28, 2016 | Bleed all animals | 3 ml EDTA | Freeze plasma in 250 uL aliquots; all PBMCs |
| Wk 8 Jan. 4, 2017 | Wk 8 Jan. 5, 2017 | Bleed all animals and immunize: 30.20 gp 160 membrane bound trimer mRNA-LNP 50 ug ID = 60 ul × 10 sites on the back | 4 ml EDTA + 2 ml SST | Freeze serum and plasma in 250 uL aliquots |
| Wk 9 Jan. 11, 2017 | Wk 9 Jan. 12, 2017 | Bleed all animals | 3 ml EDTA + 2 ml SST | Freeze serum and plasma in 250 uL aliquots |

TABLE 17-continued

| | | NHP Study #141: mRNA 6-valent gp 160 membrane bound trimers | | |
|---|---|---|---|---|
| Bleed Date | Receive @ BIDMC | Instructions (I.D. Immunizations) | Samples Qty/Volume Needed | Done at receiving laboratory |
| Wk 10 Jan. 18, 2017 | Wk 10 Jan. 19, 2017 | Bleed all animals | 3 ml EDTA + 2 ml SST | Freeze serum and plasma in 250 uL aliquots; all PBMCs |
| Wk 12 Jan. 31, 2017 | Wk 12 Feb. 1, 2017 | Bleed all animals and immunize: 30.12 gp 160 membrane bound trimer mRNA-LNP 50 ug ID = 60 ul × 10 sites on the back | 4 ml EDTA + 2 ml SST | Freeze serum and plasma in 250 uL aliquots |
| Wk 13 Feb. 8, 2017 | Wk 13 Feb. 9, 2017 | Bleed all animals | 3 ml EDTA + 2 ml SST | Freeze serum and plasma in 250 uL aliquots; all PBMCs |
| Wk 14 Feb. 14, 2017 | Wk 14 Feb. 15, 2017 | Bleed all animals | 3 ml EDTA + 2 ml SST | Freeze serum and plasma in 250 uL aliquots; all PBMCs |
| Wk 16 Feb. 28, 2017 | Wk 16 Mar. 1, 2017 | Bleed all animals and immunize: 136.B18 gp 160 membrane bound trimer mRNA-LNP 50 ug ID = 60 ul × 10 sites on the back | 4 ml EDTA + 2 ml SST | Freeze serum and plasma in 250 uL aliquots |
| Wk 17 Mar. 7, 2017 | Wk 17 Mar. 8, 2017 | Bleed all animals + Draining lymph node biopsies (inguinal) | 3 ml EDTA + 1 ml SST + Draining lymph node biopsies (inguinal) | Freeze serum and plasma in 250 uL aliquots; all PBMCs |
| Wk 18 Mar. 14, 2017 | Wk 18 Mar. 15, 2017 | Bleed all animals | 3 ml EDTA + 2 ml SST | Freeze serum and plasma in 250 uL aliquots; all PBMCs |
| Wk 20 Mar. 28, 2017 | Wk 20 Mar. 29, 2017 | Bleed all animals | 4 ml EDTA + 2 ml SST | Freeze serum and plasma in 250 uL aliquots |
| Wk 24 Apr. 25, 2017 | Wk 24 Apr. 26, 2017 | Bleed all animals | 4 ml EDTA + 2 ml SST | Freeze serum and plasma in 250 uL aliquots |
| Wk 28 May 23, 2017 | Wk 28 May 24, 2017 | Bleed all animals | 4 ml EDTA + 2 ml SST | Freeze serum and plasma in 250 uL aliquots |

TABLE 18

| | | NHP Study #142: 6-valent chimeric stabilized trimer protein (kos) | | |
|---|---|---|---|---|
| Bleed Date | Receive @ BIDMC | Instructions (I.D. Immunizations) | Samples Qty/Volume Needed | Done at BIDMC |
| Feb. 22, 2017 | Feb. 23, 2017 | Pre-LN biopsy (axillary) Pre-Bleed all animals NHP's: 150251,6857, T244,T245 | 6 ml EDTA + 2 ml SST + serum chemistry (IDEXX) + CBC (IDEXX) | Freeze serum and plasma in 250 uL aliquots; all PBMCs |
| Wk 0 Feb. 28, 2017 | Wk 0 Feb. 29, 2017 | Bleed all animals and immunize: NHP#: 150251, 6857, T244, T245 M5 chimeric stabilized trimer (kos) + Mil chimeric stabilizedtrimer (kos) IM injections | 6 ml EDTA + 2 ml SST + serum chemistry (IDEXX) + CBC (IDEXX) | Freeze serum and plasma in 250 uL aliquots; all PBMCs |

TABLE 18-continued

| | | NHP Study #142: 6-valent chimeric stabilized trimer protein (kos) | | |
|---|---|---|---|---|
| Bleed Date | Receive @ BIDMC | Instructions (I.D. Immunizations) | Samples Qty/Volume Needed | Done at BIDMC |
| Wk 1 Mar. 7, 2017 | Wk 1 Mar. 8, 2017 | Bleed all animals LN biopsy (inguinal) | 6 ml EDTA + 2 ml SST + serum chemistry (IDEXX) + CBC (IDEXX) | Freeze serum and plasma in 250 uL aliquots; all PBMCs |
| Wk 2 Mar. 14, 2017 | Wk 2 Mar. 15, 2017 | Bleed all animals | 6 ml EDTA + 2 ml SST + serum chemistry (IDEXX) + CBC (IDEXX) | Freeze serum and plasma in 250 uL aliquots; all PBMCs |
| Wk 4 Mar. 29, 2017 | Wk 4 Mar. 30, 2017 | Bleed all animals and immunize: 20.14 chimeric stabilized trimer (kos) | 6 ml EDTA + 2 ml SST + serum chemistry (IDEXX) + CBC (IDEXX) | Freeze serum and plasma in 250 uL aliquots; all PBMCs |
| Wk 5 Apr. 5, 2017 | Wk 5 Apr. 6, 2017 | Bleed all animals LN biopsy (inguinal) | 6 ml EDTA + 2 ml SST + serum chemistry (IDEXX) + CBC (IDEXX) | Freeze serum and plasma in 250 uL aliquots; all PBMCs |
| Wk 6 Apr. 12, 2017 | Wk 6 Apr. 13, 2017 | Bleed all animals | 6 ml EDTA + 2 ml SST + serum chemistry (IDEXX) + CBC (IDEXX) | Freeze serum and plasma in 250 uL aliquots; all PBMCs |
| Wk 8 Apr. 26, 2017 | Wk 8 Apr. 27, 2017 | Bleed all animals and immunize: 30.20 chimeric stabilized trimer (kos) | 6 ml EDTA + 2 ml SST + serum chemistry (IDEXX) + CBC (IDEXX) | Freeze serum and plasma in 250 uL aliquots; all PBMCs |
| Wk 9 May 3, 2017 | Wk 9 May 4, 2017 | Bleed all animals | 6 ml EDTA + 2 ml SST + serum chemistry (IDEXX) + CBC (IDEXX) | Freeze serum and plasma in 250 uL aliquots; all PBMCs |
| Wk 10 May 10, 2017 | Wk 10 May 11, 2017 | Bleed all animals | 6 ml EDTA + 2 ml SST + serum chemistry (IDEXX) + CBC (IDEXX)) | Freeze serum and plasma in 250 uL aliquots; all PBMCs |
| Wk 12 May 24, 2017 | Wk 12 May 25, 2017 | Bleed all animals and immunize: 30.12 chimeric stabilized trimer (kos) | 6 ml EDTA + 2 ml SST + serum chemistry (IDEXX) + CBC (IDEXX) | Freeze serum and plasma in 250 uL aliquots; all PBMCs |
| Wk 13 May 31, 2017 | Wk 13 Jun. 1, 2017 | Bleed all animals | 6 ml EDTA + 2 ml SST + serum chemistry (IDEXX) + CBC (IDEXX) | Freeze serum and plasma in 250 uL aliquots; all PBMCs |
| Wk 14 Jun.7, 2017 | Wk 14 Jun.8, 2017 | Bleed all animals | 6 ml EDTA + 2 ml SST + serum chemistry (IDEXX) + CBC (IDEXX) | Freeze serum and plasma in 250 uL aliquots; all PBMCs |
| Wk 16 Jun.21, 2017 | Wk 16 Jun.22, 2017 | Bleed all animals and immunize: 136.B18 chimeric stabilized trimer (kos) | 6 ml EDTA + 2 ml SST + serum chemistry (IDEXX) + CBC (IDEXX) | Freeze serum and plasma in 250 uL aliquots; all PBMCs |

TABLE 18-continued

| | NHP Study #142: 6-valent chimeric stabilized trimer protein (kos) | | | |
|---|---|---|---|---|
| Bleed Date | Receive @ BIDMC | Instructions (I.D. Immunizations) | Samples Qty/Volume Needed | Done at BIDMC |
| Wk 17 Jun.28, 2017 | Wk 17 Jun.29, 2017 | Bleed all animals LN biopsy (axillary) | 6 ml EDTA + 2 ml SST + serum chemistry (IDEXX) + CBC (IDEXX) | Freeze serum and plasma in 250 uL aliquots; all PBMCs |
| Wk 18 Jul. 5, 2017 | Wk 18 Jul. 6, 2017 | Bleed all animals | 6 ml EDTA + 2 ml SST + serum chemistry (IDEXX) + CBC (IDEXX) | Freeze serum and plasma in 250 uL aliquots; all PBMCs |

This protocol describes NHP immunization study with M5, M11, 20.14, 30.20, 30.12, 136.B18 envelopes and SIVGag. In some embodiments the below vaccination regimen could be carried out with the proteins delivered as trimers, for example but not limited to SOSIP.III trimers.

TABLE 19

| Bleed Date | Instructions | Samples Qty/Volume Needed | Notes |
|---|---|---|---|
| Pre (−12 to −4 weeks) | Collect pre samples (−12 to −4 weeks) | Plasma, PBMC, serum, saliva, rectal swab, vaginal swab, LN (axillary) | |
| Wk 0 (EP1) | Vaccination #1: M5 + M11 Vaccine HIV env gp 145 DNA & SIV gag DNA (Conserved element CE prime followed by C0-delivery of CE & complete gag boost) DNA dose = 2 mg of each construct Protein HIV gp 120. Env dose = 200 ug of each protein Adjuvant = GLA-SE 25 ug Route: IM/EP Innovio (n = 5) Group 1A Group 1B Group 1C Group 1D DNA + Protein co-immunization (both sides) = into same muscle Group 2A Group 2B Group 2C Group 2D DNA (Left side) + Protein (Right side) = separate sides and muscles Group 3A Group 3B Sham DNA and adjuvant co-immunization (Both Sides) = same muscle Group 4A Group 4B Treatment naive | Plasma, PBMC, serum, saliva, rectal swab, vaginal swab, fecal sample | |
| Wk 1 (EP1wk 1) | LN G3A, G3B, G4A, G4B @ Lt only | Plasma, PBMC, serum | |
| Wk 2 (EP1 Wk 2) | | Plasma, PBMC, serum, saliva, rectal swab, vaginal swab, fecal sample | |
| Wk 8 (EP2) | Vaccination #2: 20.14 DNA dose = 2 mg of each construct Env dose = 200 ug of each protein | Plasma, PBMC, serum | |
| Wk 9 (EP2 wk 1) | LN ing G1A, G2A @ Rt & Lt LN G3A, G3B, G4A, G4B @ Rt only | Plasma, PBMC, serum | |
| Wk 10 (EP2 wk 2) | BM G1A, G2A | Plasma, PBMC, serum, saliva, rectal swab, vaginal swab, fecal sample, vaginal bx, rectal bx | |

TABLE 19-continued

| Bleed Date | Instructions | Samples Qty/Volume Needed | Notes |
|---|---|---|---|
| Wk 16 | | Plasma, PBMC, serum | |
| Wk 24 (EP3) | Vaccination #3: 30.20 DNA dose = 2 mg of each construct Env dose = 200 ug of each protein | Plasma, PBMC, serum | |
| Wk 25 (EP3 wk 1) | LN ing G1B, G2B Rt & Lt | Plasma, PBMC, serum, | |
| Wk 26 (EP3 wk 2) | BM G1B, G2B | Plasma, PBMC, serum, saliva, rectal swab, vaginal swab, fecal sample | |
| Wk 32 | | Plasma, PBMC | |
| Wk 40 (EP 4) | Vaccination #4: 30.12 DNA dose = 2 mg of each construct Env dose = 200 ug of each protein | Plasma, PBMC, serum | |
| Wk 41 (EP 4 wk 1) | LN ing G1C, G2C Rt & Lt | Plasma, PBMC, serum | |
| Wk 42 (EP4 wk 2) | BM G1C,G2C | Plasma, PBMC, serum, saliva, rectal swab, vaginal swab, fecal sample, vaginal bx, rectal bx | |
| Wk 48 | | Plasma, PBMC | |
| Wk 56 (EP5) | Vaccination #5: 136.B18 DNA dose = 2 mg of each construct Env dose = 200 ug of each protein | Plasma, PBMC, serum | |
| Wk 57 (EP5 wk 1) | LN ing G1D, G2D Rt & Lt | Plasma, PBMC, serum | |
| Wk 58 (EP5 wk 2) | BM G1D, G2D *Necropsy 2 animals | Plasma, PBMC, serum, saliva, rectal swab, vaginal swab, fecal sample | |
| Wk 64 | | Plasma, PBMC | |
| Wk 74 | | Plasma, PBMC, serum, saliva, rectal swab, vaginal swab, fecal sample | |

Non-limiting example of an immunization protocols with Selection F (M5, M11, 20.14, 30.20, 30.12, 136.B18). In this example the immunogens are delivered as mRNA formulated in nanoparticles. In some embodiments the stabilized trimers are of the design SOSIP.III.

Materials needed: Formulate mRNA for 6 monkeys. 6 doses×50 ug/nhp=300 ug of each mRNA construct.

Collections of Plasma, Serum, and PBMC: Collect all plasma and serum in 250 uL aliquots and save all PBMCs. CBC collection: 850 uL from each animal Animal studies using the above protocols could be carried out with the immunogens of Selection G (EnvSeq-2), or Selection H (EnvSeq-3).

Animal studies with envelopes CH505 T/F, as stable trimers are also contemplated. Non-limiting examples of such studies include: CH505 T/F as gp145 nucleic acid prime (once or twice), followed by sequential SOSIP 4.1 trimers of CH505 T/F, CH505 w53.16, CH505 w78.33, CH505 w100.B6. In some embodiments there is no nucleic acid prime and immunization regimen comprises sequential SOSIP 4.1 trimers of CH505 T/F, CH505 w53.16, CH505 w78.33, CH505 w100.B6. In some embodiments the nucleic acid is mRNA. In some embodiments the nucleic acid is DNA. In some embodiments the DNA is administered via electroporation. In some embodiments of these studies, animals could be boosted with CH505 w136.B8.

Example 8: Maturation Pathway from Germline to Broad HIV-1 Neutralizer of a CD4-Mimic Antibody Antibodies with ontogenies from $V_H1$-2 or $V_H1$-46-germline genes dominate the broadly neutralizing response against the CD4-binding site (CD4bs) on HIV-1. Here we define with longitudinal sampling from time-of-infection the development of a $V_H1$-46-derived antibody lineage that matured to neutralize 90% of HIV-1 isolates. Structures of lineage antibodies CH235 (week 41 from time-of-infection, 18% breadth), CH235.9 (week 152, 77%) and CH235.12 (week 323, 90%) demonstrated the maturing epitope to focus on the conformationally invariant portion of the CD4bs. Similarities between CH235 lineage and five unrelated CD4bs lineages in epitope focusing, length-of-time to develop breadth, and extraordinary levels of somatic hypermutation suggested commonalities in maturation among all CD4bs antibodies. Fortunately, the required CH235-lineage hypermutation appeared substantially guided by the intrinsic mutability of the $V_H1$-46 gene, which closely resembled $V_H1$-2. We integrated our CH235-lineage findings with a second broadly neutralizing lineage and HIV-1 co-evolution to suggest a vaccination strategy for inducing both lineages. See Cell. 2016 Apr. 7; 165(2):449-63. GenBank Accession numbers of the CH235UCA heavy and light chains are KU570032.1 and KU570045.1

Accession Numbers

Coordinates and structure factors for CH235, CH235.9 and CH235.12 in complex with HIV-1 gp120 have been deposited with the Protein Data Bank (PDB ID 5F9W, 5F9O and 5F96). Next-generation sequencing data have been deposited with the NCBI Sequence Reads Archive (SRP067168). Antibody heavy and light chains have been deposited with GenBank (KU570032-KU570053).

Antibodies Names Correlation: See supra.

Example 9: HIV-1 Envelope Trimers and Other Envelope Designs

This example shows that stabilized HIV-1 Env trimer immunogens show enhanced antigenicity for broadly neutralizing antibodies, and are not recognized by non-neutralizing antibodies. See also FIGS. 22-25, 59,61-74, 81-82. The example also describes additional envelope modifications and designs. In some embodiments these envelopes, including but not limited to trimers are further multimerized, and/or used as particulate, high-density array in liposomes or other particles, for example but not limited to nanoparticles. Any one of the envelopes of the invention could be designed and expressed as described herein.

A stabilized chimeric SOSIP.III design was used to generate 10 CH505 trimers. The CH505 TF SOSIP.III bound the CH103 UCA. Binding affinity of the CH103 lineage to the CH505 TF SOSIP.III correlates with neutralization potency against CH505 TF virus. This design was applicable to diverse viruses from multiple clades.

These results indicate that the native trimer on virions could have initiated the CH103 lineage during natural infection. CH103 recognizes all three protomers on the Env trimer. The SOSIP.III mimicked the native trimer on the virion in that stronger binding to it correlated with neutralization potency for the CH103 lineage. The SOSIP.III design enables soluble mimics of the native trimer to be tested as sequential immunogens in CH505 B cell lineage design vaccination. These trimers enable our efforts to utilize B cell lineage design with trimeric immunogens.

Elicitation of neutralizing antibodies is one goal for antibody-based vaccines. Neutralizing antibodies target the native trimeric HIV-1 Env on the surface virions. The trimeric HIV-1 envelope protein consists of three protomers each containing a gp120 and gp41 heterodimer. Recent immunogen design efforts have generated soluble near-native mimics of the Env trimer that bind to neutralizing antibodies but not non-neutralizing antibodies. The recapitulation of the native trimer could be a key component of vaccine induction of neutralizing antibodies. Neutralizing Abs target the native trimeric HIV-1 Env on the surface of viruses (Poignard et al. J Virol. 2003 January; 77(1):353-65; Parren et al. J Virol. 1998 December; 72(12):10270-4; Yang et al. J Virol. 2006 November; 80(22):11404-8.). The HIV-1 Env protein consists of three protomers of gp120 and gp41 heterodimers that are noncovalently linked together (Center et al. J Virol. 2002 August; 76(15):7863-7.). Soluble near-native trimers preferentially bind neutralizing antibodies as opposed to non-neutralizing antibodies (Sanders et al. PLoS Pathog. 2013 September; 9(9): e1003618).

Sequential Env vaccination has elicited broad neutralization in the plasma of one macaque (Example 5B). The overall goal of our project is to increase the frequency of vaccine induction of bnabs in the plasma of primates with sequential Env vaccination. We hypothesized that vaccination with sequential immunogens that target bnAb B cell lineage and mimic native trimers will increase the frequency of broadly neutralizing plasma antibodies. One goal is increase the frequency of vaccine induction of bnAb in the plasma of primates by sequential Env vaccination. It is expected that vaccination with sequential immunogens that target bnAb B cell lineages and mimic the native trimers on virions will increase the frequency of broadly neutralizing plasma antibodies.

Previous work has shown that CH505 derived soluble trimers are hard to produce. From a study published by Julien et al in 2015 (Proc Natl Acad Sci USA. 2015 Sep. 22; 112(38): 11947-11952.) it was shown that while CH505 produced comparable amounts of protein by transient transfection, only 5% of the CH505 protein formed trimer which 5 times lower than the gold standard viral strain BG505. Provided here are non-limiting embodiments of well-folded trimers for Env immunizations.

Near-native soluble trimers using the 6R.SOSIP.664 design are capable of generating autologous tier 2 neutralizing plasma antibodies in the plasma (Sanders et al. 2015), which provides a starting point for designing immunogens to elicit broadly neutralizing antibodies. While these trimers are preferentially antigenic for neutralizing antibodies they still possess the ability to expose the V3 loop, which generally results in strain-specific binding and neutralizing antibodies after vaccination. Using the unliganded structure the BG505.6R.SOSIP.664 has been stabilized by adding cysteines at position 201 and 433 to constrain the conformational flexibility such that the V3 loop is maintained unexposed (Kwon et al. Nat Struct Mol Biol. 2015 July; 22(7): 522-531.).

Figure 22A:
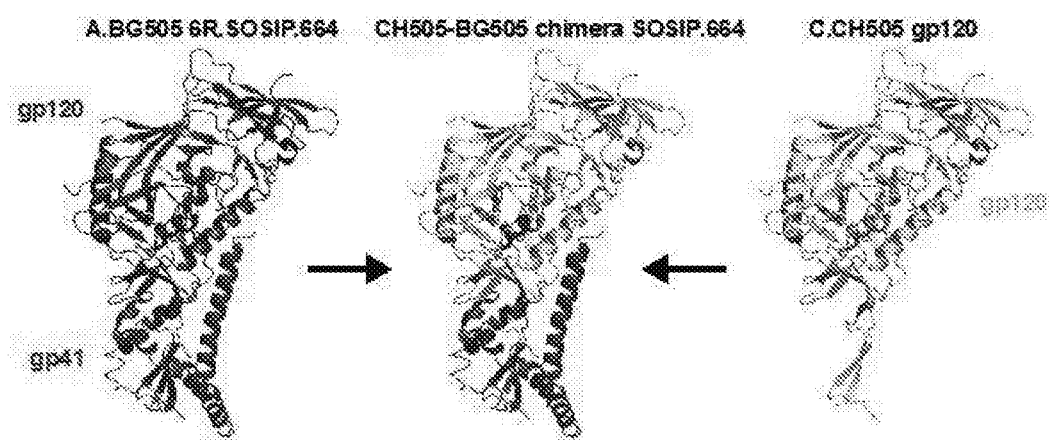
FIG. 22A shows CH505 chimeric 6R.SOSIP.664 design. The gp120 of CH505 (right) except the c-terminal 37 amino acids was transplanted into the well-characterized A.BG505 6R.SOSIP.664 (left). The transplantation design takes advantage of the enhanced stability of the A.BG505 strain. The resultant chimeric molecule (center) has the CH505 gp120 (yellow) fused to the 37 c-terminal amino acids of A.BG505 (blue) and the A.BG505 gp41 (magenta).

Immunogen design. Provided are engineered trimeric immunogens derived from multiple viruses from CH505. We generated chimeric 6R.SOSIP.664, chimeric disulfide stabilized (DS) 6R.SOSIP.664 (Kwon et al Nat Struct Mol Biol. 2015 July; 22(7): 522-531.), chimeric 6R.SOSIP.664v4.1 (DeTaeye et al. Cell. 2015 Dec. 17; 163(7):1702-15. doi: 10.1016/j.cell.2015.11.056), and chimeric 6R.SOSIP.664v4.2 (DeTaeye et al. Cell. 2015 Dec. 17; 163(7):1702-15. doi: 10.1016/j.cell.2015.11.056). The 6R.SOSIP.664 is the basis for all of these designs and is made as a chimera of C.CH0505 and A.BG505. The gp120 of C.CH505 was fused with the BG505 inner domain gp120 sequence within the alpha helix 5 (α5) to result in the chimeric protein. The chimeric gp120 is disulfide linked to the A.BG505 gp41 as outlined by Sanders et al. (PLoS Pathog. 2013 September; 9(9): e1003618). These immunogens were designed as chimeric proteins that possess the BG505 gp41 connected to the CH505 gp120, since the BG505 strain is particularly adept at forming well-folded, closed trimers (FIG. 22A). This envelope design retains the CH505 CD4 binding site that is targeted by the CH103 and CH235 broadly neutralizing antibody lineages that were isolated from CH505.

Figure 23B:
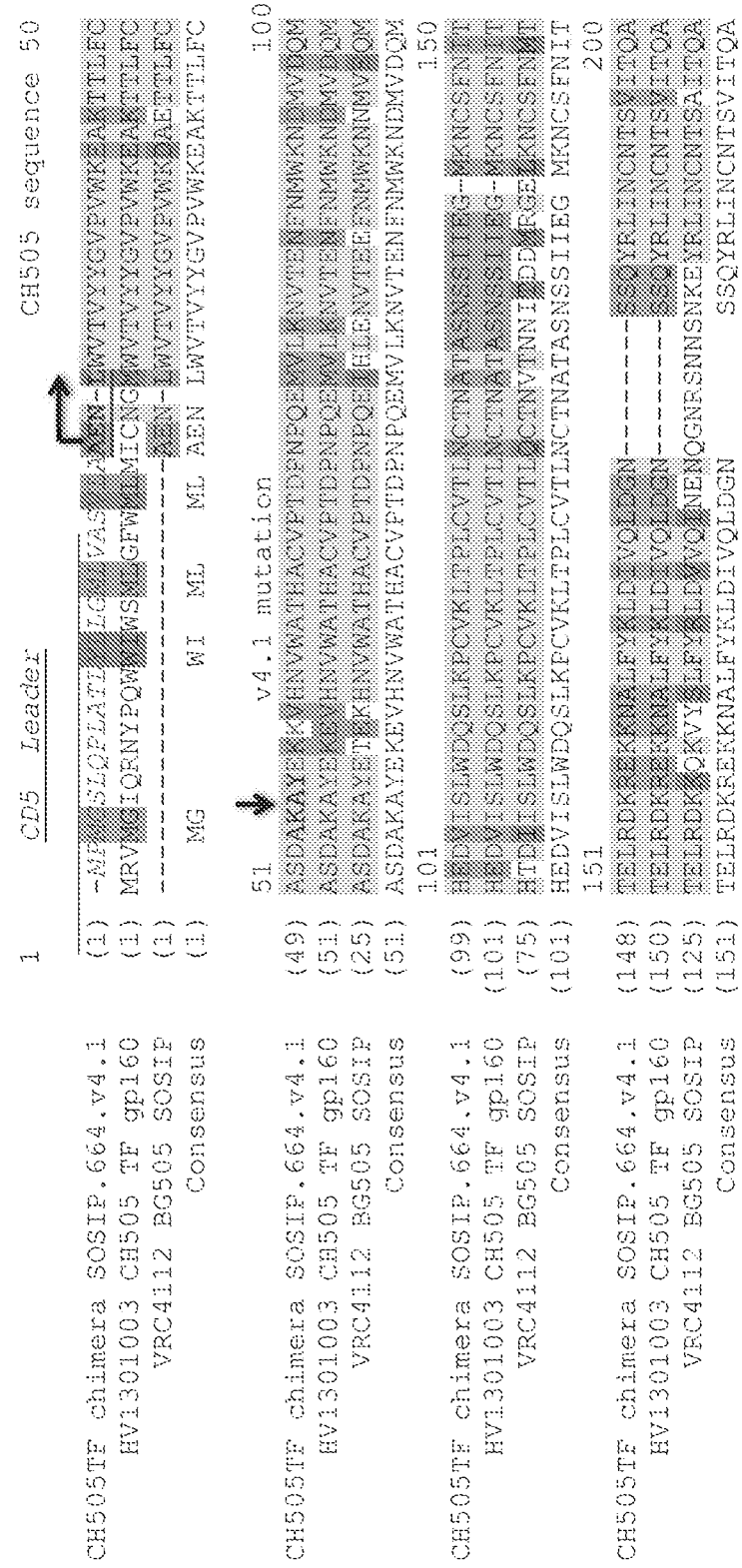
FIG. 23B shows annotated sequence of SOSIP.III design (SEQ ID NOS 274-276, respectively, in order of appearance).

FIGS. 22 and 23 show nucleic acid and amino acid and sequences of various CH505 envelope trimer designs. FIG. 23B shows an annotated sequence of the SOSIP.III design. Based on the various SOSIP designs, any other suitable envelope, for example but not limited to CH505 envelopes as described in WO2014042669 can be designed.

Recombinant envelopes as trimers could be produced and purified by any suitable method. For a non-limiting example of purification methods see Ringe R P, Yasmeen A, Ozorowski G, Go E P, Pritchard L K, Guttman M, Ketas T A, Cottrell C A, Wilson I A, Sanders R W, Cupo A, Crispin M, Lee K K, Desaire H, Ward A B, Klasse P J, Moore J P. 2015. Influences on the design and purification of soluble, recombinant native-like HIV-1 envelope glycoprotein trimers. J Virol 89:12189-12210. doi:10.1128/JVI.01768-15.

Multimeric Envelopes

Presentation of antigens as particulates reduces the B cell receptor affinity necessary for signal transduction and expansion (See Baptista et al. EMBO J. 2000 Feb. 15; 19(4): 513-520). Displaying multiple copies of the antigen on a particle provides an avidity effect that can overcome the low affinity between the antigen and B cell receptor. The initial B cell receptor specific for pathogens can be low affinity, which precludes vaccines from being able to stimulate and expand B cells of interest. In particular, very few naïve B cells from which HIV-1 broadly neutralizing antibodies arise can bind to soluble HIV-1 Envelope. Provided are envelopes, including but not limited to trimers as particulate, high-density array on liposomes or other particles, for example but not limited to nanoparticles. See e.g. He et al. Nature Communications 7, Article number: 12041 (2016), doi:10.1038/ncomms12041; Bamrungsap et al. Nanomedicine, 2012, 7 (8), 1253-1271.

To improve the interaction between the naïve B cell receptor and CH505 SOSIP trimer protein we created to two constructs that can be presented on particles. The first construct was made by fusing HIV-1 Envelope trimer CH505 to ferritin (See FIG. 24G). Ferritin protein self assembles into a small nanoparticle with three-fold axis of symmetry. At these axis CH505 envelope protein was fused. Therefore, the assembly of the three-fold axis also clusters three HIV-1 envelope protomers together to form an envelope trimer. Each ferritin particle has 6 axes which equates to 6 CH505 trimers being displayed per particle. See e.g. Sliepen et al. Retrovirology201512:82, DOI: 10.1186/s12977-015-0210-4; See also FIG. 24H-J.

Another approach to multimerize expression constructs uses staphylococcus Sortase A transpeptidase ligation to conjugate CH505 envelope trimers to cholesterol. The CH505 trimers can then be embedded into liposomes via the conjugated cholesterol. To conjugate the CH505 trimer to cholesterol either a C-teminal LPXTG tag (SEQ ID NO: 396) or a N-terminal pentaglycine repeat tag (SEQ ID NO: 307) was added to the CH505 envelope trimer gene. Cholesterol was also synthesized with these two tags. Sortase A was then used to covalently bond the tagged CH505 envelope to the cholesterol. The sortase A-tagged trimer protein can also be used to conjugate the trimer to other peptides, proteins, or fluorescent labels.

The invention provides design of envelopes and trimer designs wherein the envelope comprises a linker which permits addition of a lipid, such as but not limited to cholesterol, via a Sortase A reaction. See e.g. Tsukiji, S. and Nagamune, T. (2009), Sortase-Mediated Ligation: A Gift from Gram-Positive Bacteria to Protein Engineering. ChemBioChem, 10: 787-798. doi:10.1002/cbic.200800724; Proft, T. Sortase-mediated protein ligation: an emerging biotechnology tool for protein modification and immobilisation. Biotechnol Lett (2010) 32: 1. doi:10.1007/s10529-009-0116-0; Lena Schmohl, Dirk Schwarzer, Sortase-mediated ligations for the site-specific modification of proteins, Current Opinion in Chemical Biology, Volume 22, October 2014, Pages 122-128, ISSN 1367-5931, dx.doi.org/10.1016/j.cbpa.2014.09.020; Tabata et al. Anticancer Res. 2015 August; 35(8):4411-7.

The lipid modified envelopes and trimers could be formulated as liposomes. Any suitable liposome composition is contemplated.

Non-limiting embodiments of envelope designs for use in Sortase A reaction are shown in FIG. 24 B-D.

Design of Trimers with Readthrough Codons

The development of clonal cell lines that highly express trimeric HIV-1 Envelope will facilitate manufacturing of high quality proteins for clinical and research purposes. However, it is challenging to identify the cells that express trimeric protein among the many cells making various forms of HIV-1 Envelope with in the cell population. To identify cells expressing trimeric HIV-1 Envelope protein, we designed an expression construct that simultaneously produces both secreted Envelope protein as well as membrane anchored Envelope protein. The secreted Envelope protein can be purified using standard methods and results in unaltered soluble envelope. The membrane-anchored Envelope protein serves to mark the cells within a population of cells that expresses trimeric Envelope. More specifically, the trimeric Envelope expressing cells are sorted by fluorescence-activated cell sorting using a HIV-1 trimer specific antibody. The sorted cells can then be used to initiate clonal populations of cells that have been phenotypically shown to express the protein of interest.

Figure 24A:
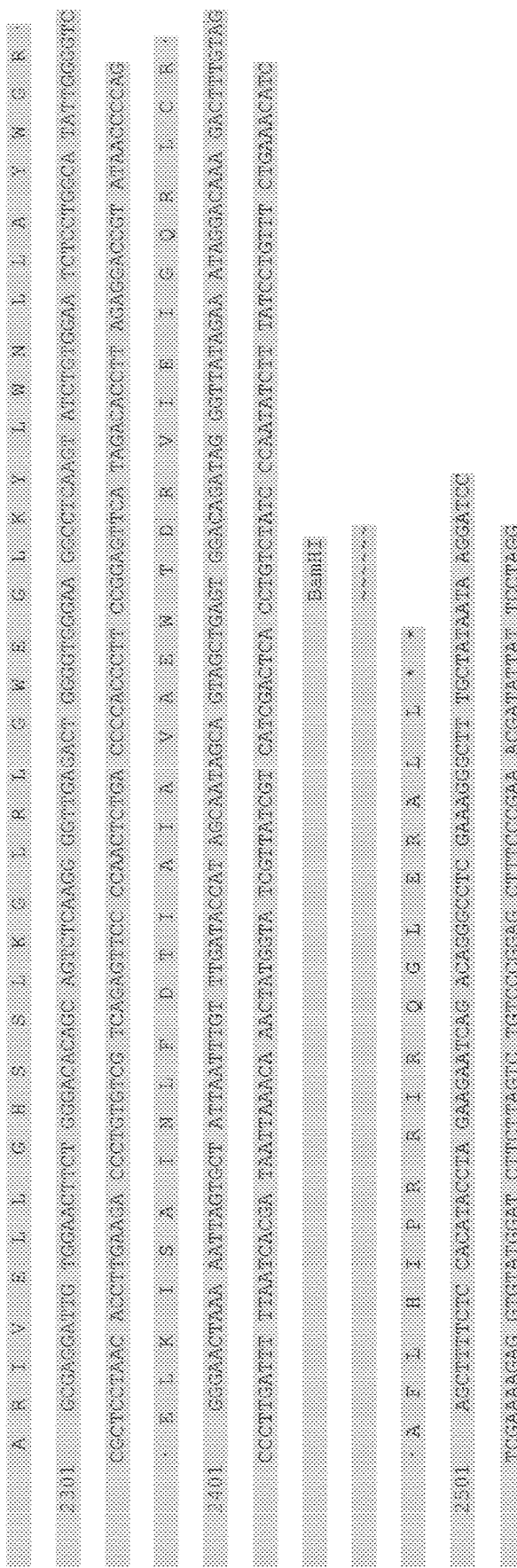
FIG. 24A shows amino acid and nucleic acid sequences of designs CH505TF.6R.SOSIP.664.v4.1_AMBRCTA and AMBRCTAG, and designs CH505M5chim.6R.SOSIP.664v4.1_AMBRCTA and AMBRCTAG (SEQ ID NOS 277-288, 290, 289, 292, 291, 294, 293, 295, and 296, respectively, in order of appearance). See also Example 9.
Figure 24C:
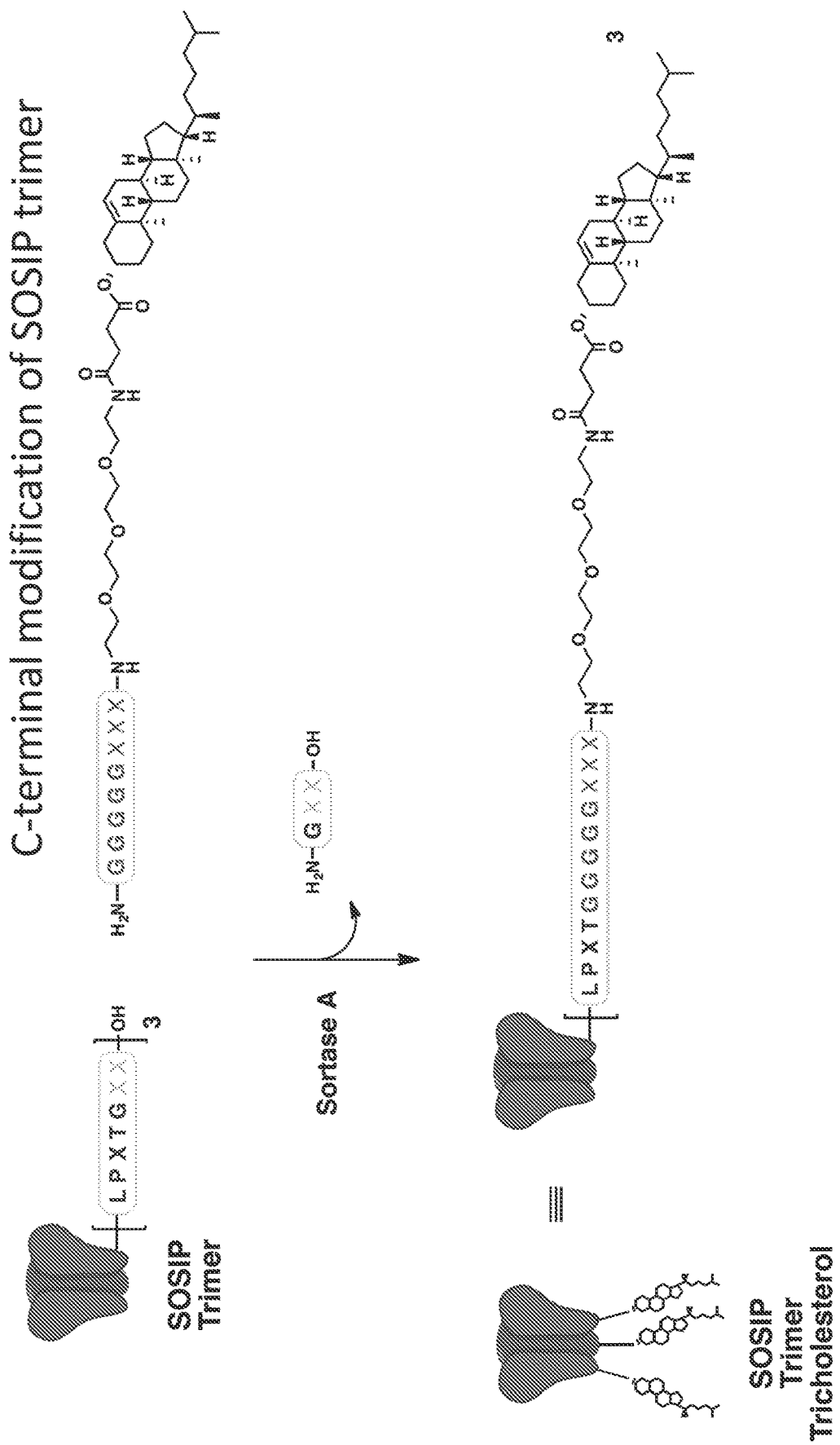
FIGS. 24B, C and D show sortase designs and nucleic acid and protein sequences (SEQ ID NOS 297-308, respectively, in order of appearance).
FIG. 24E shows the PGT151 antibody staining of 293F cells transiently transfected with AMBRCTA and AMBRCTAG constructs of FIG. 24A. Only the TM constructs show surface expression of Trimeric Envelope.
FIG. 24F shows the quantification of SOSIP trimer in the supernatant of cells transfected with the constructs of FIG. 24A
FIG. 24G shows ferritin designs (SEQ ID NOS 309-313, respectively, in order of appearance).
FIG. 24H shows antigenicity of M5 SOSIPv4.1 ferritin particle.
FIG. 24I shows comparison of binding of the M5 trimer alone versus the M5 trimer multimerized on the ferritin particle.
FIG. 24J shows negative stain EM of M5 trimers on the ferritin particle. The ring in the middle is ferritin and the trimer is the spikes coming off of the ring.
Figure 24D:
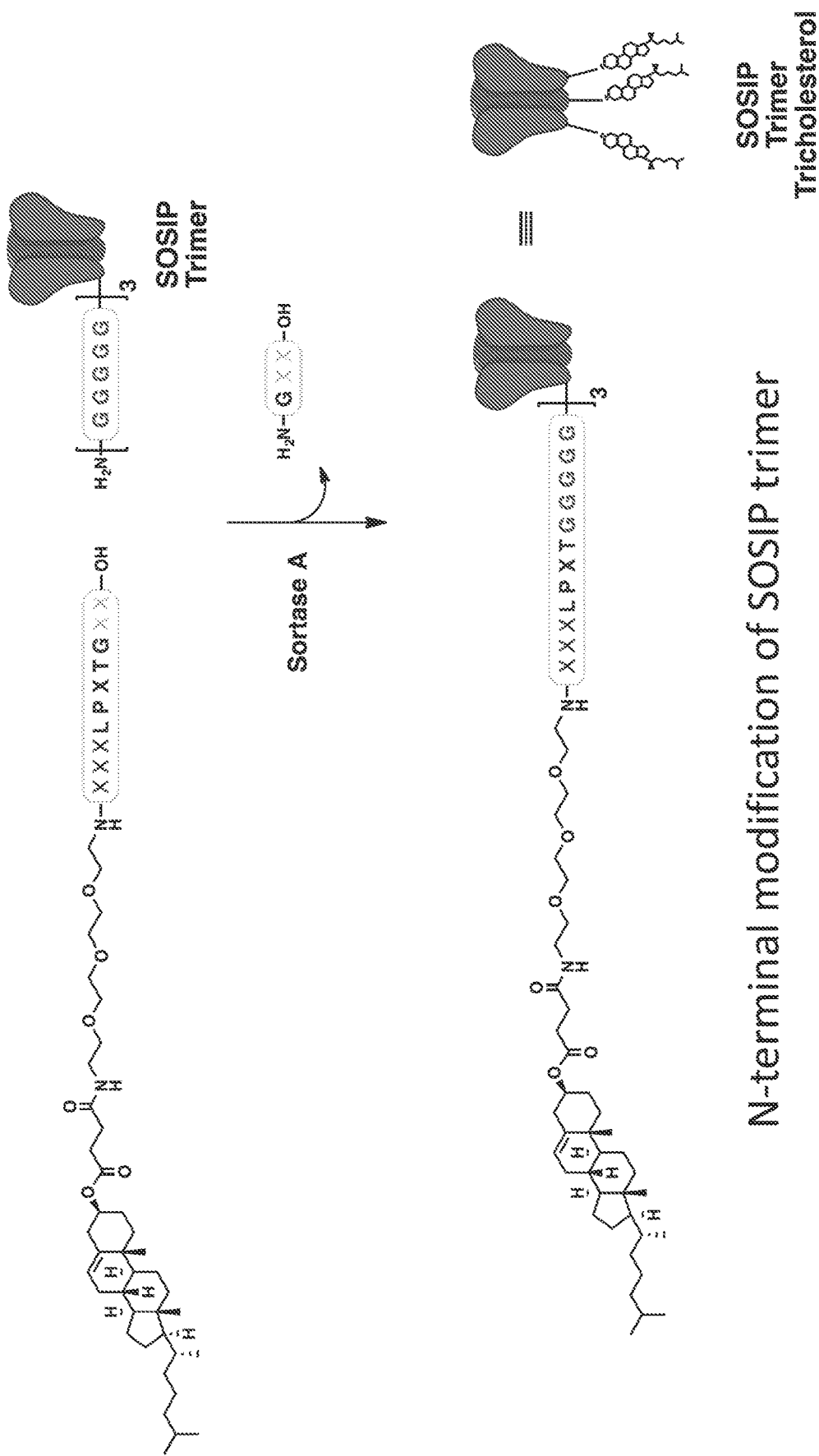
Figure 24E:
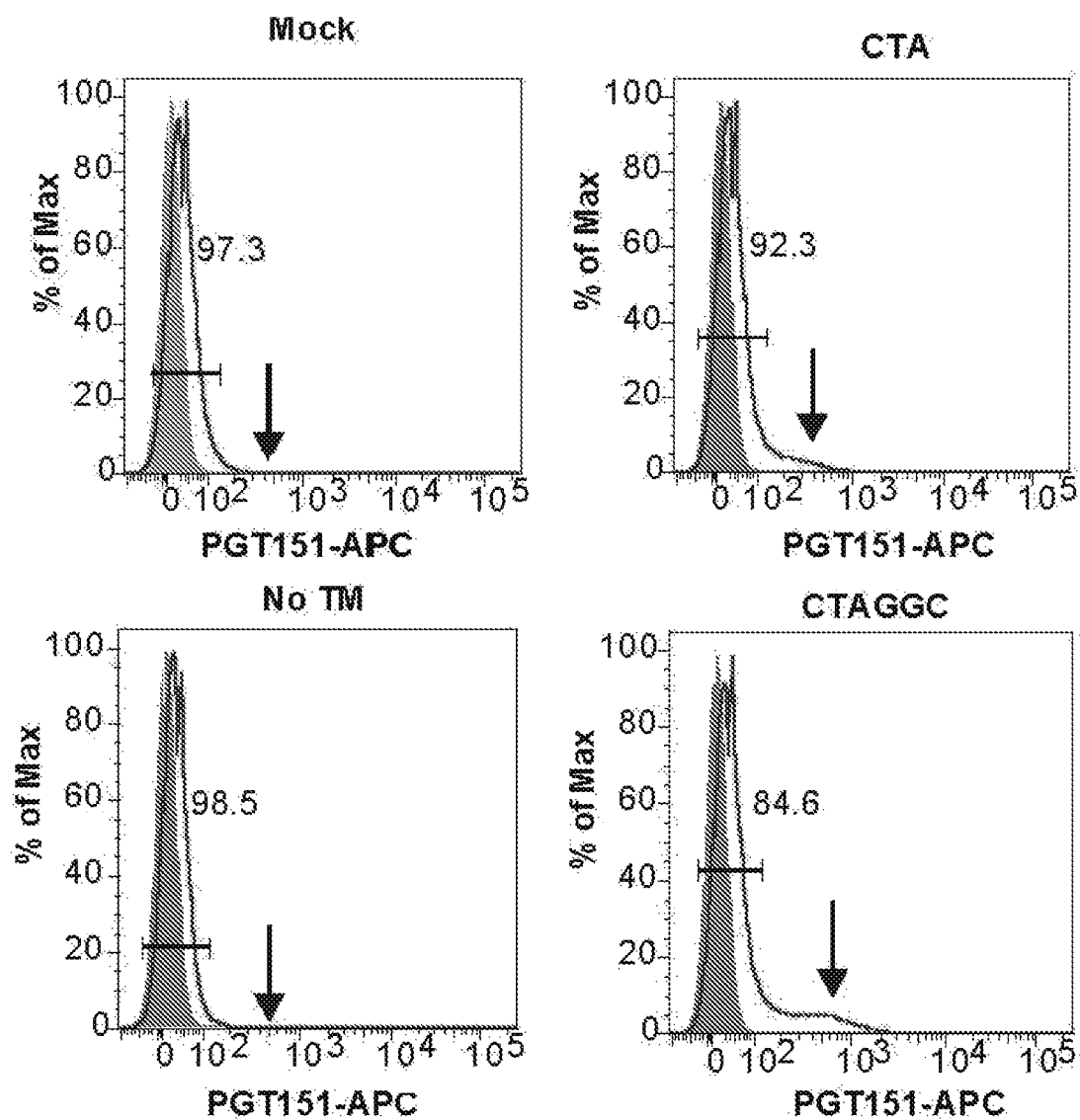
Figure 24F:
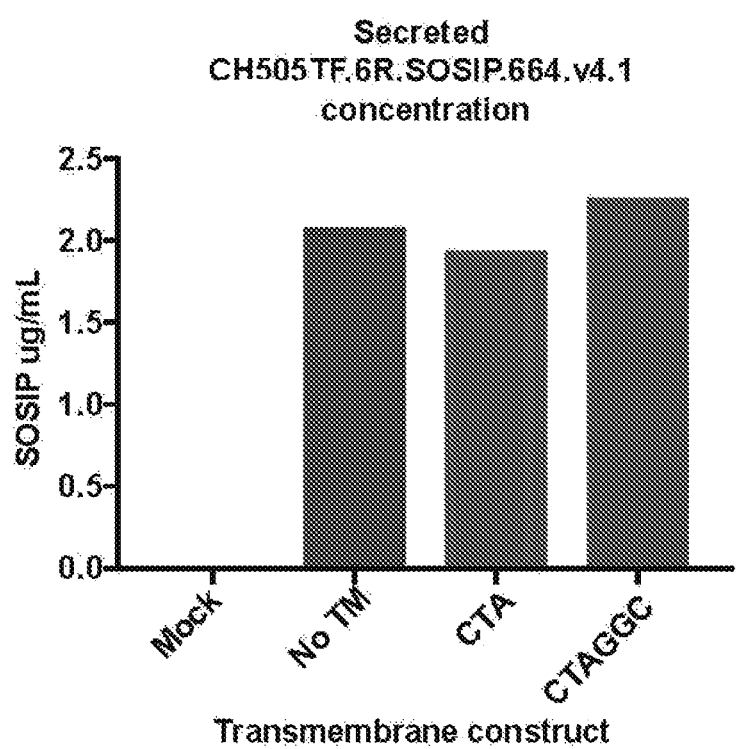
Figure 24H:
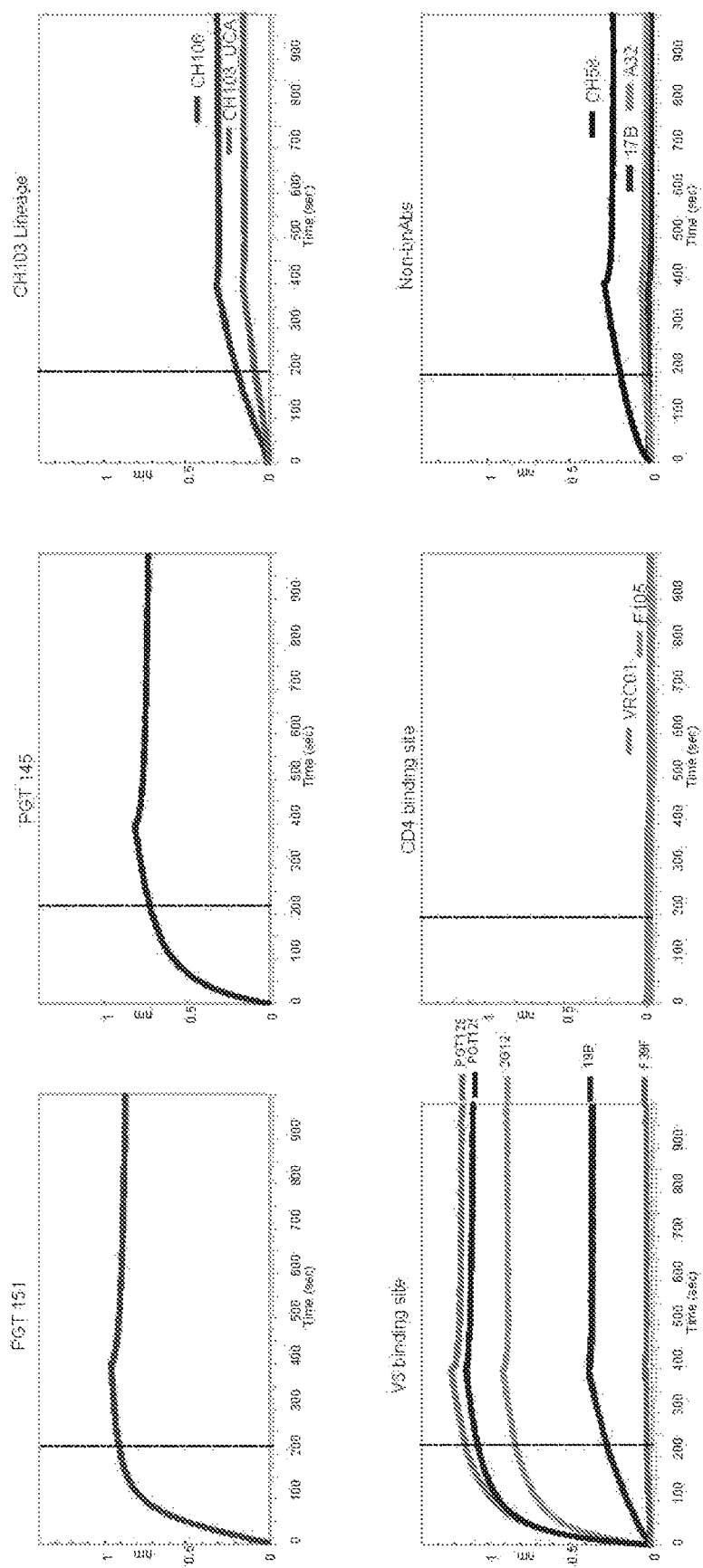
Figure 25:
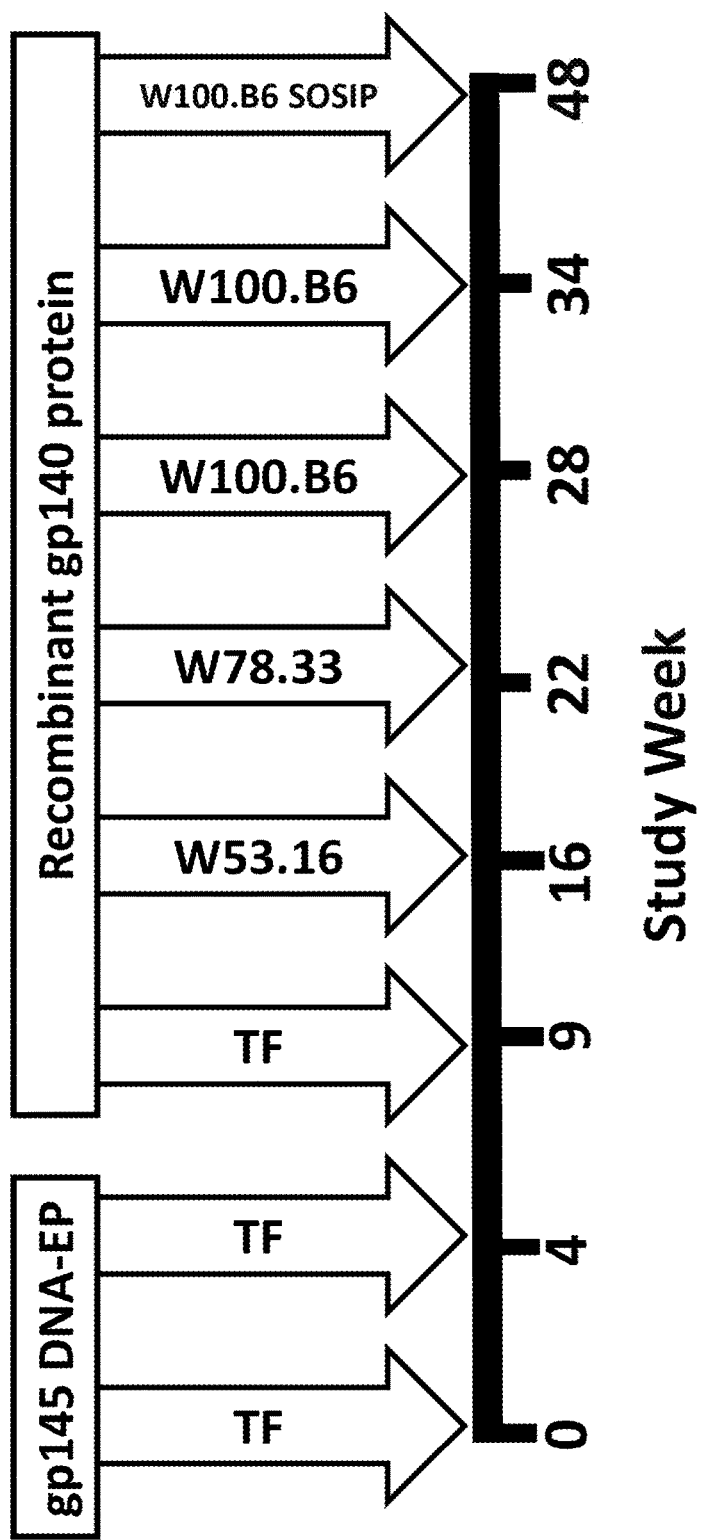
FIG. 25 shows design of rhesus macaque immunogenicity study. The immunization schedule is shown in this figure. The study compared the immunogenicity of the CD40 targeted Env to the wildtype Env in a rhesus macaque immunogneicity study. The macaques were immunized intramuscularly and electroporated twice with DNA encoding the CH505 T/F gp145. After DNA priming the macaques were administered sequential CH505 recombinant gp140C oligomers from the transmitted founder virus, and weeks 53, 78, and 100. Three macaques were immunized with the CH505 Envs conjugated to CD40 and 4 macaques were administered the CH505 Env as gp140C envelopes. We examined binding antibody titer by ELISA, neutralizing antibody titers by the TZM-bl assay, and profiled the antibody repertoire by monoclonal antibody isolation. The study analyzed the immunogenicity of wildtype and CD40-targeted Env using antibody ELISA binding, TZM-bl neutralization assay, and will isolate monoclonal antibodies.
Figure 26:
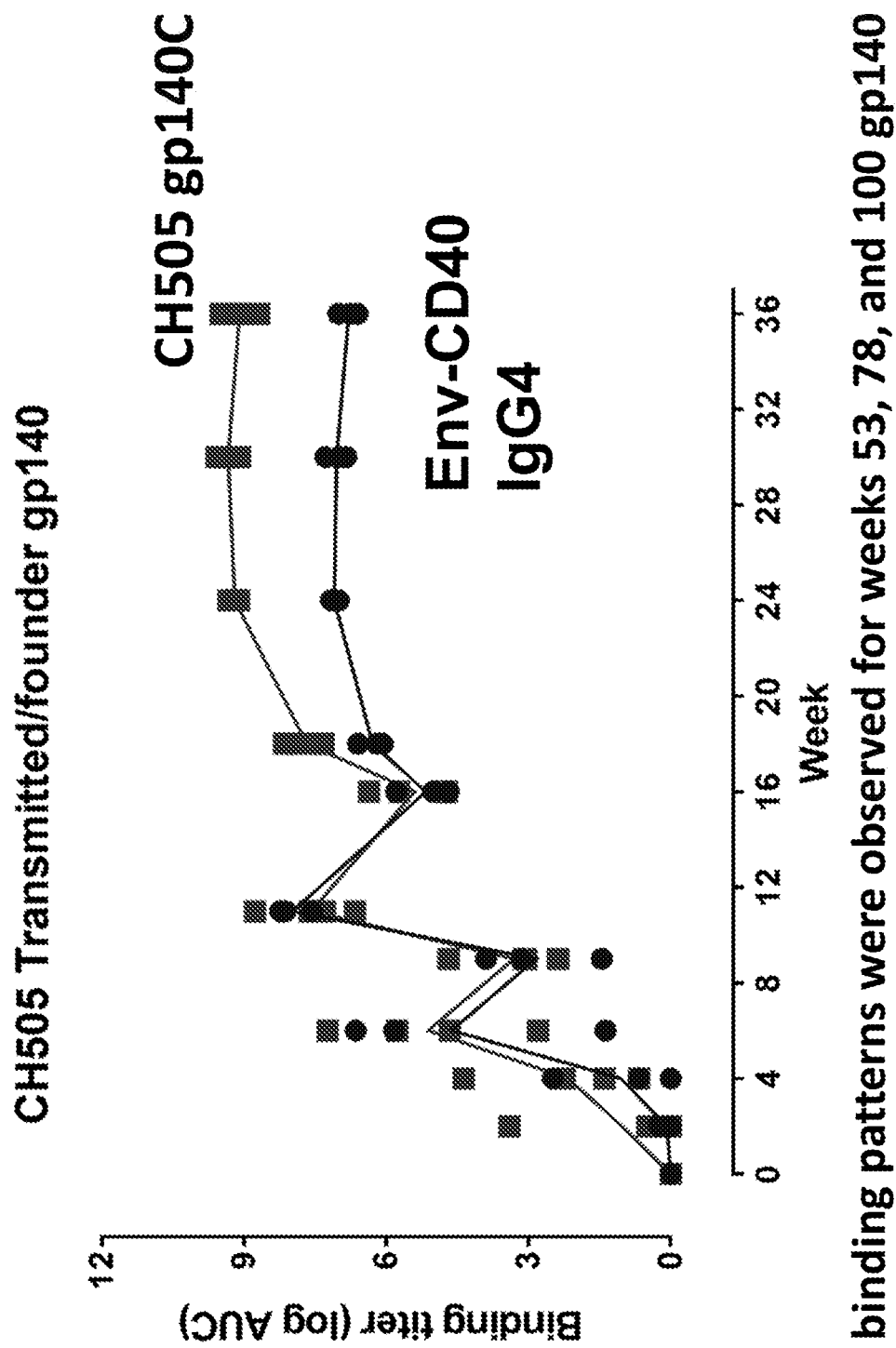
FIG. 26 shows plasma IgG responses to CH505 transmitted/founder gp140. This figure shows the binding titers over time with each symbol representing an individual macaque and the red line and symbol indicating those animals that received the wildtype Env. The macaques that were immunized with the Env conjugated to anti-CD40 are shown in blue. The titers in both groups was comparable until week 18 which was 2 weeks after the second protein boost. After that boost with the week 53 Env the wildtype group tended to have higher binding antibody titers.
Figure 27:
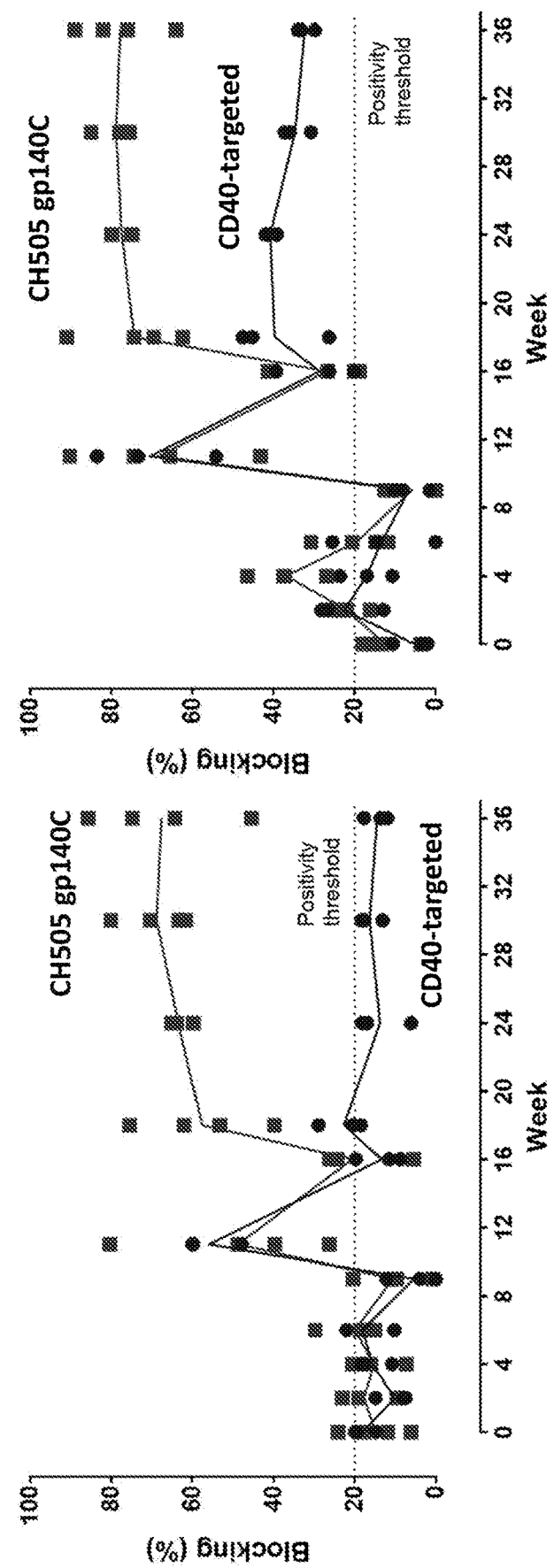
FIG. 27 shows CH505 gp140 vaccination induces plasma blocking of CD4 binding. The figure shows whether CD4 binding site antibodies were present in the plasma using competition ELISAs for soluble CD4 (shown on the left and a bnAb from the CH103 lineage called CH106 shown on the right. We examined the plasma blocking activity shown on the y-axis over time and found that at week 18 the CD4 binding site response was dramatically reduced to near background levels in the CD40 IgG4—Env group compared to the wildtype Env which showed 70 and 80% blocking of soluble CD4 and CH106 respectively.
Figure 28:
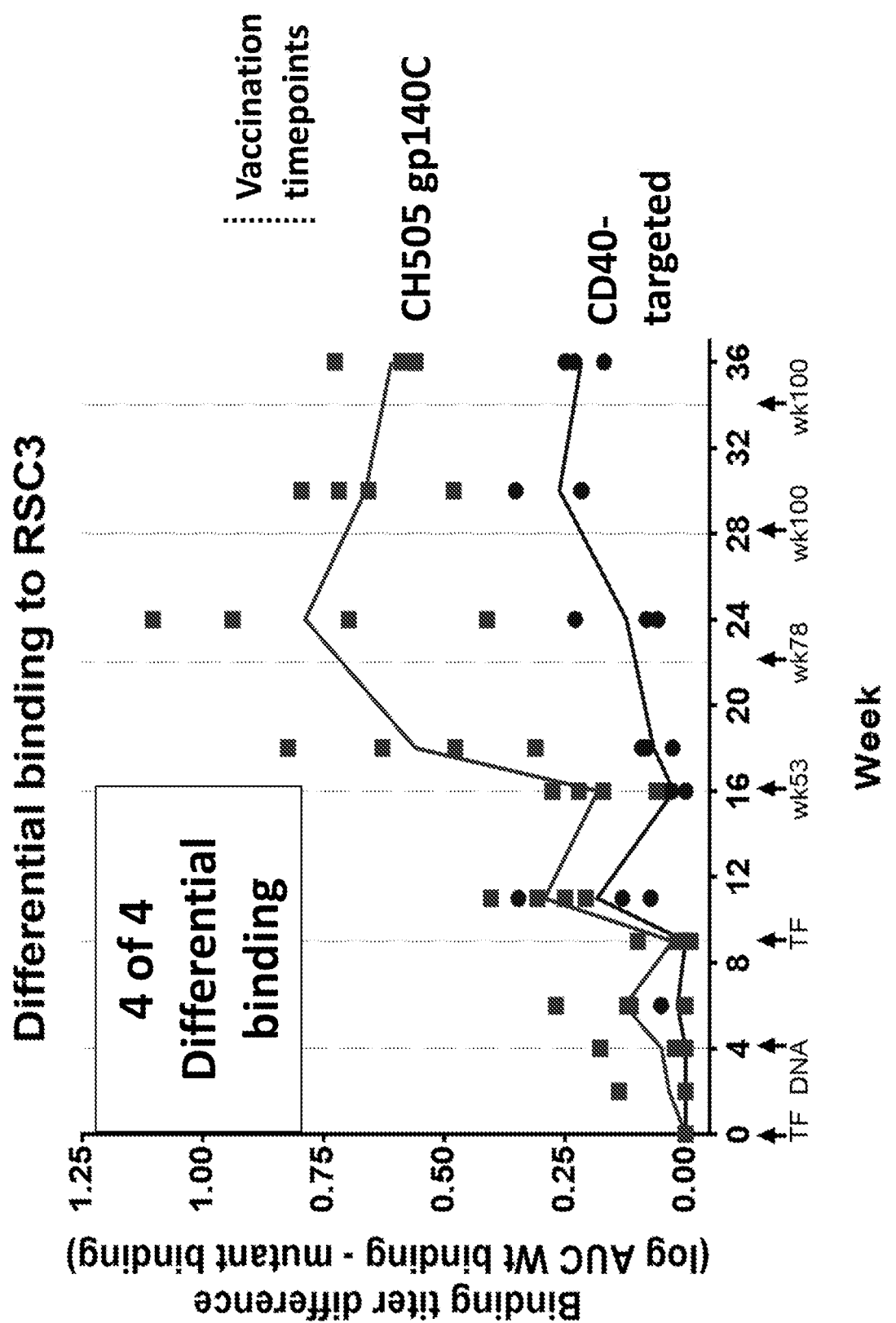
FIG. 28 shows that plasma IgG exhibits CD4 binding site-directed binding to a resurfaced gp120 core. This figure shows the ability of the plasma IgG from all four animals to bind to RSC3 or its CD4 knock out mutant. Shown here is the difference in binding between the wildtype RSC3 and the CD4 binding site mutant over time.
Figure 29:
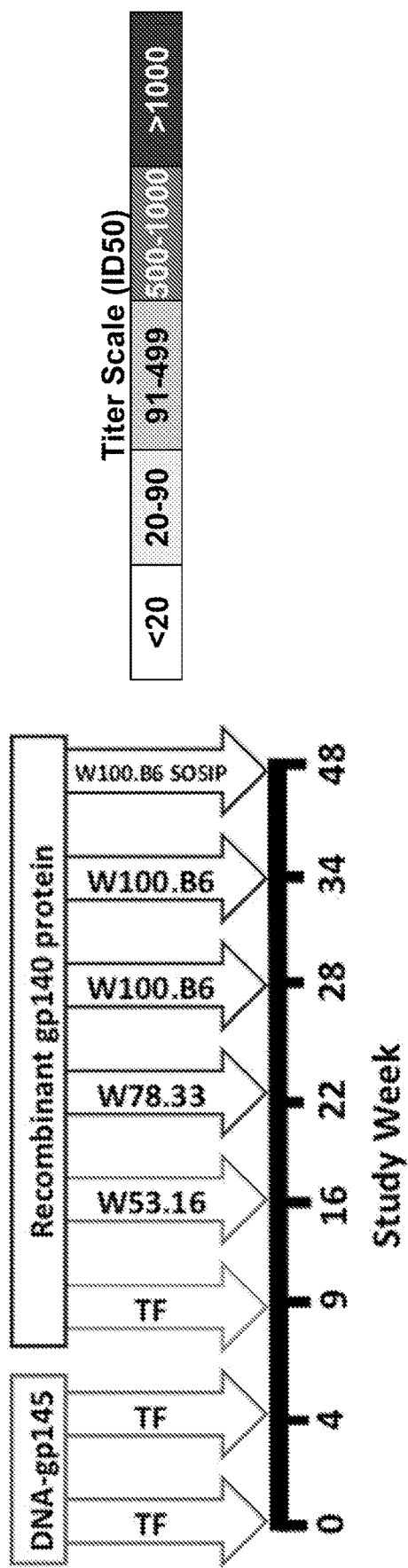
FIG. 29 shows CH505 gp140 vaccination elicits high titers of autologous tier 1 virus neutralization. This figure shows the neutralization titers for each macaque represented as ID50 reciprocal dilutions against a tier 1 virus called CH505 w4.3 isolated from the CH505 individual early in infection. All 4 animals generated relatively high titers of tier 1 neutralizing antibodies beginning with the protein boost. The titers were increased with subsequent boosts with the sequential vaccine, and notably these tier 1 neutralizing antibodies were typical for our CH505 Env vaccinations that have been performed in macaques.
Figure 30:
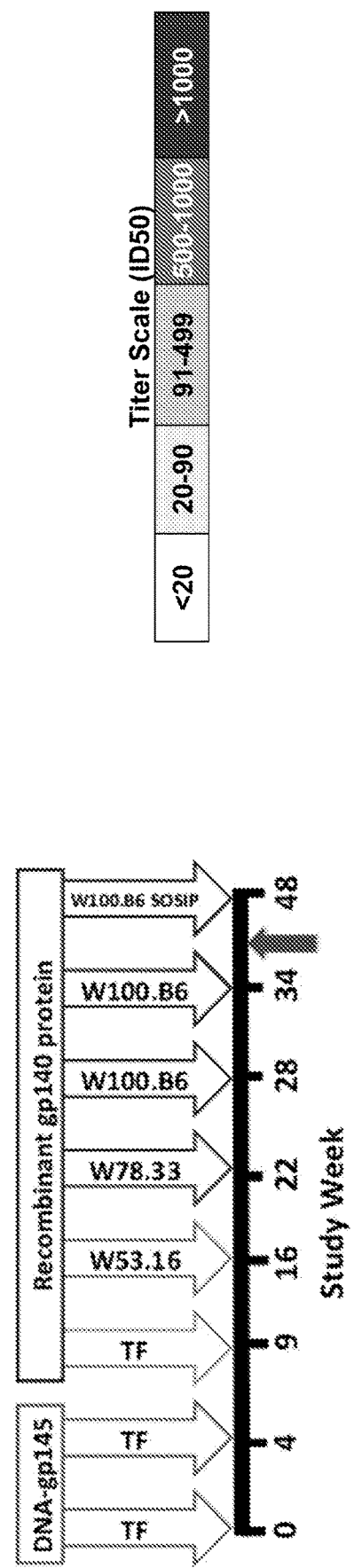
FIG. 30 shows CH505 gp140 sequential vaccination boosts autologous tier 2 CH505 TF virus neutralization. This figure shows autologous tier 2 neutralization by the plasma from each macaque. The ID50 titers are shown for each macaque and we observed 1 of 4 macaques generated autologous tier 2 neutralizing antibodies in the plasma. Detectable neutralization first occurred after the CH505 week 53 Env protein boost and increased with each boost. This result was striking since this macaque was the first vaccinated macaque where we observed neutralization of the CH505 TF virus.
Figure 31:
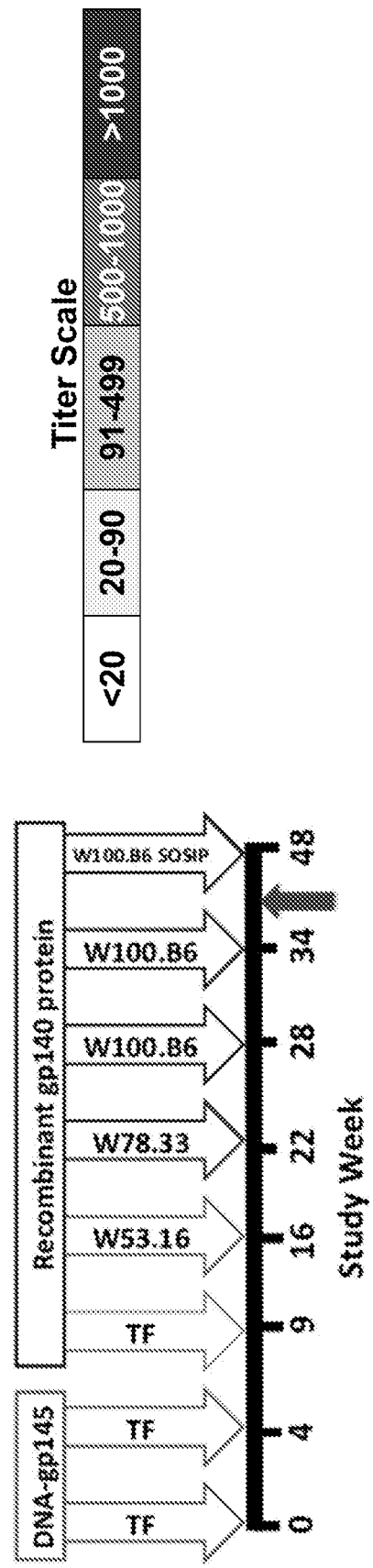
FIG. 31 shows autologous neutralizing antibodies against all four tier 2 viruses increased with sequential boosting. This figure shows the autologous tier 2 neutralization analysis to include the tier 2 CH505 viruses that comprise the sequential vaccination regimen. The same macaque 6207 was able to neutralize all four tier 2 CH505 viruses. The neutralization was detectable against 3 of 4 of the CH505 viruses after only 2 protein boosts, and by three boosts all 4 viruses were neutralized. We saw the neutralizing titers continued to increase with each boost.
Figure 33:
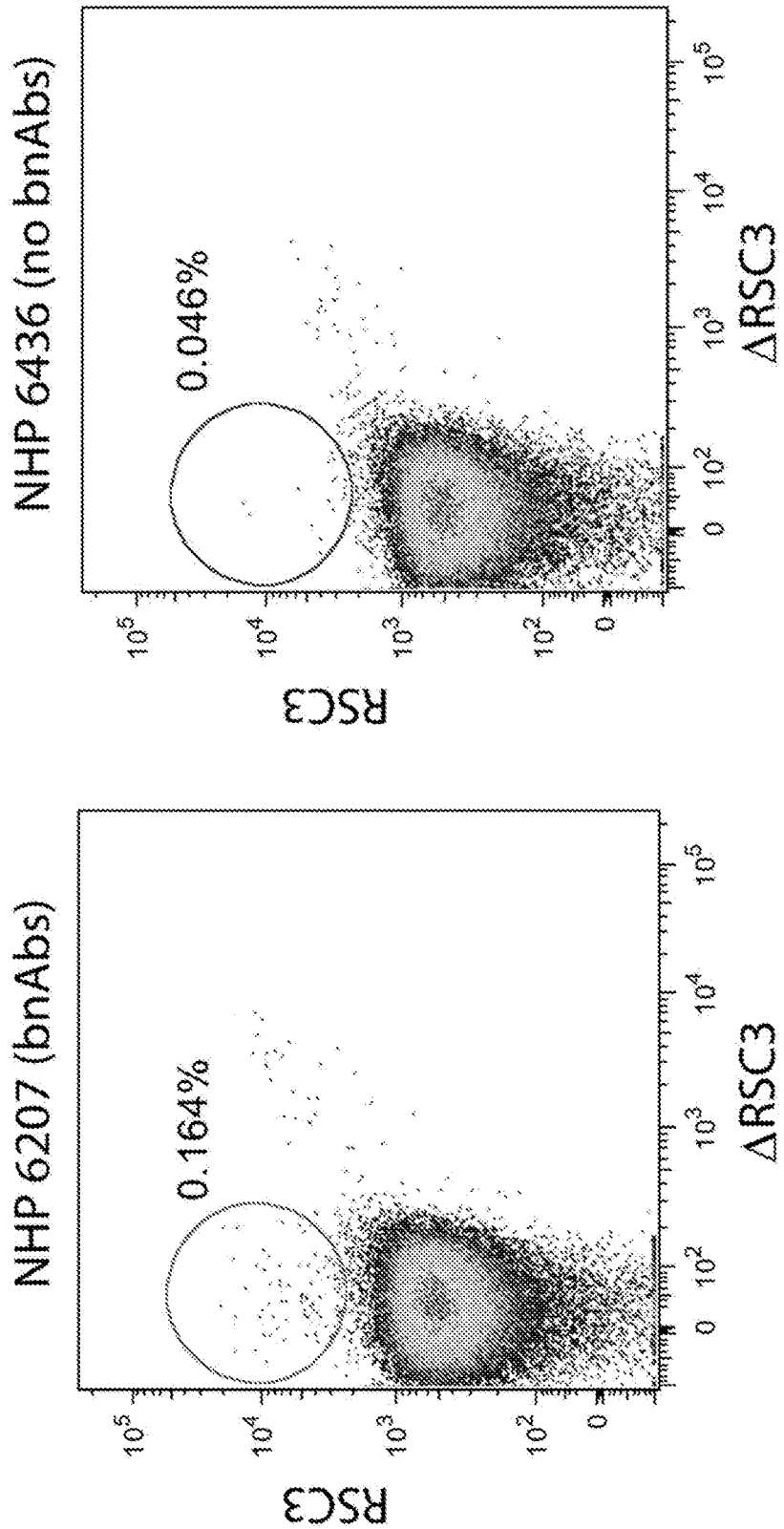
FIG. 33 shows B cell sorting for CD4 binding site differential antibodies. Memory B cells from two macaques were sorted and compared the presence of RSC3-reactive B cells that did not bind the CD4 knock out mutant version of the protein called delta RSC3. A representative FACS plot is shown on the left for the NHP 6207 who possessed SCL70 reactive plasma IgG and developed broadly neutralizing antibodies in its plasma. For comparison we sorted RSC3-reactive B cells from NHP 6436, which did not have broad neutralization in the plasma but was the other macaque that tested positive for auto antibodies. The NHP 6207 had a relatively large percentage of RSC3 reactive B cells whereas NHP6436 had very few.
Figure 34:
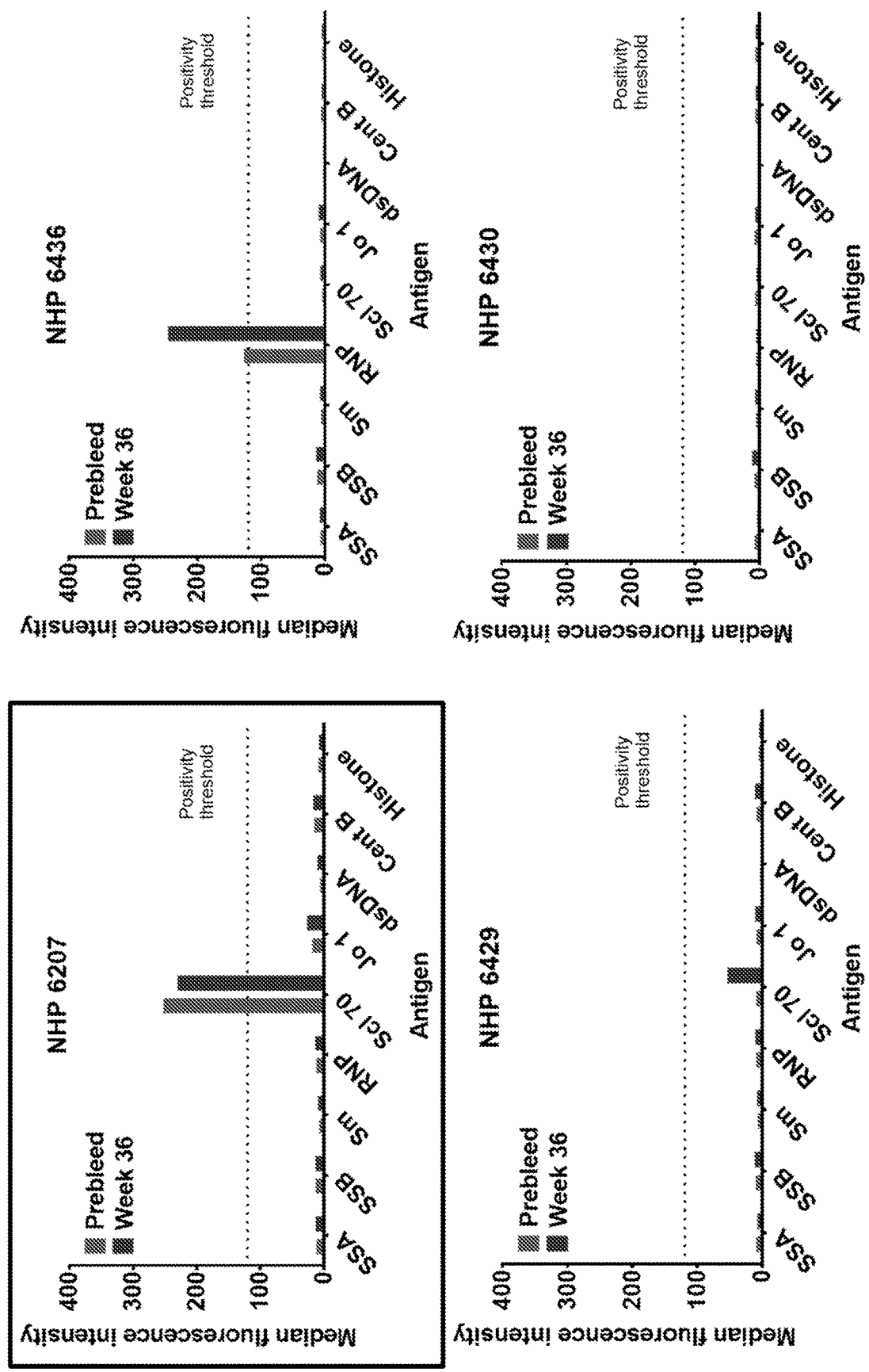
FIG. 34 shows macaque 6207 has broad plasma neutralization and antibodies against Scl70. This figure shows autoreactivity measured in the Athena assay for each of the four macaques that received the wildtype CH505 gp140C envelopes in vaccination. Median fluorescence intensity for binding to each autoantigen listed on the x-axis is depicted in separate graphs for each macaque. The positivity threshold for the assay is marked by the dotted line. Interestingly, the macaque that possessed broad neutralization possessed binding antibodies to the autoantigen SCL70, which is correlated of the autoimmune disease scleroderma. The antibodies were present prior to vaccination indicated by the binding in the grey bar. One other macaque tested positive for autoantibodies, but it bound to a different autoantigen.

The expression construct is designed by taking advantage of the amber stop codon UAG in messenger RNA. The codon UAG usually signifies the end of the polypeptide sequence, but at a low rate the ribosome can readthrough this stop codon and continue to elongate the polypeptide chain. We incorporated this stop codon into our protein construct followed by the natural BG505 gp41 transmembrane and cytoplasmic tail sequence ended with two stop codons. Therefore, when the stop codon is readthrough a membrane-anchored gp120/gp41 heterodimer is formed. Loughran et al. (2014) identified that the efficiency of readthrough could be increased by flanking the amber stop codon with the nucleotides CTA. Readthrough could be even further augmented with the addition of CTAG nucleotides after the amber stop codon. We engineered expression constructs with both modifications to ensure an optimal ratio of membrane-anchored and secreted trimeric Envelope protein. Since the CTAG creates a shift in reading frame we added GC nucleotides after the CTAG motif to preserve the original reading frame. The addition of CTAGGC results in the membrane anchored protein having a leucine and glycine residue expressed before the transmembrane domain. FIG. 24A shows non-limiting examples of readthrough designs. FIG. 24E and FIG. 24F show expression of "CTA" and "CTAGGC" designs in transiently transfected 293F cells. Any one of the envelopes of the invention could be designed and expressed as readthrough envelopes.

Example 10: HIV Envelope Modifications for Germline Targeting of CD4bs Broadly Neutralizing Antibodies Germline B cell stimulation is a key initial step in the ability of HIV vaccines to elicit broadly neutralizing antibodies (bNAbs). Several bNAb lineages are known to target the CD4 binding site of HIV-1 envelope glycoprotein gp120, and these lineages are of particular interest for vaccines. Here we describe specific modifications of HIV-1 gp120 and gp140 to trigger germline activation and drive subsequent B cell maturation of CD4bs bNAbs. These modifications are two-fold: 1) site-specific mutagenesis of a glycine residue at position 458 of gp120, changing this residue to a tyrosine (G458Y mutation) and 2) biosynthesis of the G458Y mutated envelope glycoproteins in cells lacking the enzyme N-acetylglucosaminyltransferase, resulting in an enrichment of Man5 glycoforms of N-linked glycans that would otherwise be processed into complex-type glycans. Together these modifications permit the envelope glycoproteins of HIV-1 strain CH0505 to interact with germline forms of the CD4bs bNAb CH235.

We began these studies by testing the potency of CD4bs bNAbs and other HIV-1 bNAbs against viruses that were produced in either 293T or 293s/GnTI$^{-/-}$ cells. The latter cells were used to produce Man5-enriched glycoforms of pseudoviruses, with the rationale that a relatively small Man5 glycan would replace larger complex-type glycans that naturally exist and contribute to CD4bs masking. The oligosaccharide composition of HIV-1 Env consists mostly of under-processed high mannose (Man5-9 GlcNac2) glycans because steric constraints imposed by the highly glycosylated and trimeric structure Env impede the actions of α-mannosidases that are needed for complete processing (1-4). The smaller fraction of fully processed glycans exists mainly as sialylated bi-, tri- and tetra-antennary complex-type glycans (5-7), some of which border the CD4bs (5, 8). Importantly, nascent Env glycans that are trimmed by α-mannosidases and progress to complex-type glycans will remain as under-processed Man5 glycans in the absence of the enzyme UDP-N-acetylglucosamine:α-D-mannoside-β1, 2-N-acetylglucosaminyltransferase (GnTI) (9), which is responsible for attachment of GlcNAc to Man5GlcNAc2 in the medial-Golgi as a requisite step for complete processing. HIV-1 Env proteins produced in 293s/GnTI$^{-/-}$ cells are known to be enriched for Man5 glycans, although as expected under-processed high mannose glycoforms (Man6-9) also exist (9, 10). There is at least one report of improved potency of mature CD4bs bNAbs against viruses produced in GnTI$^{-/-}$ cells (11).

Shown in FIG. 75 are the neutralization potencies of a panel of HIV-1 bNAbs to multiple epitopes. The bNAbs were assayed against a tier 2 strain of HIV-1 Env-pseudotyped virus (TRO.11) produced in either 293T or 293s/GnTI$^{-/-}$ cells (Man5-enrichment). With the exception of IgG1b12 and HJ16, the CDbs bNAbs showed markedly greater potency against Man5-enriched virus. HJ16 was negatively impacted by Man5-enrichment, while IgG1b12 failed to neutralize both forms of the virus. Man5-enrichment had little or no impact on the neutralizing activity of other bNAbs.

Despite the improved potency of many mature CD4bs bNAbs against Man5-enriched virus, germline-reverted forms of these bNAbs possessed no detectable neutralizing activity against either form of the virus (FIG. 75). We next sought to determine whether neutralization by germline forms of the CD4bs bNAbs would be detected by combining Man5-enrichment and targeted glycan removal. Our initial efforts used targeted glycan-deleted Envs designed by others to bind germline-reverted forms of VRC01-class CD4bs bNAbs. We began by evaluating a series of glycan-deleted variants of the clade C strain 426c described by Stamatatos and colleagues (12, 13). A V1-V3 deleted form of 426c gp140 lacking three glycans, one at position 276 in loop D that contacts the light chains of VRC01 and NIH45-46 (14, 15), and two at positions 460 and 463 in V5 that modulate VRC01 sensitivity (16), permit nanomolar affinity binding of germline-reverted forms of VRC01 and NIH45-46, whereas binding is undetectable against wild-type 426c gp140 (12). These mutations also permit activation of B cells expressing germline-reverted BCRs of VRC01 and NIH45-46 in vitro (12), and they activate germline-reverted BCR of 3BNC60 in transgenic mice (13).

We examined parental 426c and three variants of this virus containing a single mutation that removes the 276 glycan (426c.SM), a double mutation that removes 460 and 463 glycans (426c.DM), or a triple mutation that removes all three glycans (426c.TM). To preserve infectivity, the V1-V3 deletion that was introduced in the purified protein to facilitate exposure of the CD4bs remained intact in the Env-pseudotyped viruses. The neutralization phenotype of these viruses was extensively characterized with HIV-1 sera, a panel of mAbs that preferentially neutralize Tier 1 viruses, and a panel of bNAbs (Table 20, left columns). Loss of 1, 2 or 3 glycans had little or no effect on HIV-1 sera and did not render the virus sensitive to mAbs that preferentially neutralize Tier 1 viruses. Thus the glycan-deleted viruses maintained a Tier 2 phenotype. The viruses all resist neutralization by the MPER bNAb 2F5, the V2-glycan bNAbs CH01, PG9, PG16 and PGDM1400, the V3-glycan bNAbs PGT121 and PGT128, the glycan bNAb 2G12 and the CD4bs bNAbs HJ16 and b12. All four viruses were sensitive to the MPER bNAbs 4E10 and DH511.2_K3, the V3-glycan bNAb 10-1074 and the gp120/gp41 bNAbs PGT151 and VRC34.1, and these bNAbs were not affected by glycan deletion.

The only bNAbs clearly affected by glycan deletion were the CD4bs bNAbs VRC01, 3BNC117, VRC-CH31 and CH103 (boxed in red in Table 20). In particular, VRC01 and 3BNC117 were approximately 10-100 times more potent against 426c.TM than against the parental virus. Enhanced potency of 3BNC117 required all 3 glycans to be removed. VRC01 also required removal of all 3 glycans for maximum potency but unlike 3BNC117 it exhibited moderately enhanced potency seen against the single and double mutants. VRC-CH31 exhibited potent activity against the parental virus and double mutant but was inactive against the single and triple mutant, indicating a strict requirement for the presence of the N276 glycan. For CH103, modest neutralizing activity was seen against the double and triple mutant, while the parental and single mutant resisted neutralization at the highest concentration tested (40 µg/ml). All four viruses were resistant to CH235. Thus, overall the glycan-deleted variants of 426c provided little or no advantage for detecting CH103 and CH235 when produced in 293T cells.

Despite a nearly 100-fold improved potency of VRC01 against 426c.TM, we were unable to detect neutralization of this virus by germline-reverted VRC01. Part of the reason may due to the fact that the virus contains an intact V1-V3 region, whereas this region was deleted in the 426c.TM gp140 antigen that bound germline-reverted VRC01. Because V1-V3-deleted Env-pseudotyped viruses are non-infectious, we sought to determine whether Man5-enrichment would serve as an alternative strategy to further unmask the CD4bs on 426c.TM and enable detection of neutralizing activity by germline-reverted VRC01.

When parental 426c Env and the single, double and triple glycan-deleted variants of this Env were made as pseudoviruses in GnTI$^{-/-}$ cells and assayed in TZM-bl cells, all four viruses were infectious and maintained a Tier 2 neutralization phenotype (Table 20, columns on the right). Notably, they were also remarkably sensitive to neutralization by several CD4bs bNAbs (VRC01, 3BNC117, VRC-CH31 and CH103) compared to their 293T-grown counterparts (Table 20 and FIG. 76). Man5-enriched 426c.TM provided the most sensitive detection of VRC01, 3BNC117 and CH103 (IC50 of 0.015, 0.003 and 0.09 µg/ml, respectively), whereas Man5-enriched 426c.DM provided the most sensitive detection of VRC-CH31 (0.02 µg/ml). Man5-enrichment had little or no measurable effect on bNAbs to most other epitopes. The only exception was a 100-fold diminished potency of the gp120/gp41 bNAb PGT151 against the Man5-enriched viruses. Man5-enrichment had no impact on another gp120/gp41 bNAb, VRC34.1. These latter two bNAbs recognize overlapping but distinct epitopes (17).

We tested whether the 426c glycan mutants produced in GnTI$^{-/-}$ cells would permit detection of neutralization by a germline-reverted form of CD4bs bNAbs. As shown in FIG. 77 (top), near germline-reverted VRC01 (containing mature HCDR3) neutralized Man5-enriched 426c.SM and 426c.TM with IC50s of 0.9 µg/ml and 2.5 µg/ml, respectively. Little or no activity was detected against Man5-enriched 426c.DM and 426c, indicating a dependency on the presence of the N276 glycan, which is not the case for mature VRC01. No activity was detected against any of the 426c viruses produced in 293T cells, indicating a requirement for both Man5-enrichment and removal of targeted glycans to permit neutralization. Notably, no neutralization of the parental or targeted glycan-deleted viruses was seen with a more germline form of VRC01, whether the viruses were grown in 293T or GnTI$^{-/-}$ cells (data not shown).

We tested near germline forms (mature HCDR3) of several additional VRC01-class bNAbs (VRC03, VRC04, VRC07, VRC18b, VRC20, VRC23 and VRC-CH31) and found that Man5-enriched 426c.TM permits detection of neutralization by near germline VRC07 (IC50=1.6 µg/ml) and VRC20 (IC50=4.6 µg/ml) (FIG. 78A). We also tested four intermediates of VRC-CH31. All intermediates of the VRC01-CH31 lineage neutralized 426c and 426c.DM produced in 293T cells; however, dramatic improvements in neutralization potency of 50-80 fold were seen against the Man5-enriched 426c.DM (FIG. 77, bottom).

We further showed that neutralization of Man5-enriched 426c.TM by near germline VRC01-class bNAbs is completely abolished when a VRC01 escape mutation (D279K) (16) is introduced (FIG. 78B). These results indicated that we are able to detect near-germline forms of VRC01-class bNAbs and confirm their epitope specificity.

While Man5-enriched glycoforms of glycan-deleted 426c Envs were useful for detecting near germline forms of VRC01-class bNAbs, they were not capable of detecting neutralization by germline and early intermediates of other CD4bs bNAb lineages, including CH103 and CH235. We investigated targeted glycan-deleted variants of the autologous transmitted/founder Env (CH0505TF) that evolved and gave rise to CH103 and its CH235 helper lineage (18, 19). As seen in Table 21, CH0505TF lacking four glycans at positions 197, 461/462, 276 and 362 (CH0505TF.gly4) demonstrated >1,000-fold enhanced sensitivity to early intermediates of the CH103 lineage compared to parental CH0505TF. Interestingly, Man5-enrichment showed only minor enhancement in sensitivity to these intermediates, with the exception of germline CH103 that was only detected with Man5-enriched CH0505TF.gly4. Intermediates of CH235 were detected at various levels with parental CH0505TF, CH0505TF.gly4 and CH0505TF.gly3.197 viruses, and this level of detection was much greater with Man5-enriched (GnTI$^{-/-}$) versions of the viruses. No neutralization was detected with CH235 UCA.

We next sought to identify site-directed mutations that would allow us to map the epitopes of the activity detected with the CH103 and CH235 intermediates. Although these epitopes are well-characterized, the identification of diagnostic mutants would facilitate epitope mapping of polyclonal sera (e.g., vaccine sera) to determine whether positive neutralizing activity is related to these lineages. We began by testing the UCAs, intermediates and mature forms of CH235 for neutralizing activity against a G458Y mutant of CH0505TF. This mutation was chosen because it is a known escape mutation for VRC01-class bNAbs (20). CH0505TF was chosen because it was the only virus neutralized by early intermediate CH235_I4_v2_4A (Table 21). Surprisingly, rather than render the viruses less sensitive to neutralization, the presence of this mutation rendered the virus more susceptible to neutralization by the CH235 lineage, an effect that was more pronounced with Man5-enriched virus (Table 22). Even more remarkable, the combination of G458Y and Man5-enrichment now permitted detection of neutralization by three inferred UCAs of CH235 (Table 22, FIG. 79). No neutralization by the UCAs was detected when the G458Y mutant virus was produced in 293T cells, or when the parental virus was produced in 293s GnTI$^{-/-}$ cells, indicating a requirement for both the G458Y mutation and Man5-enrichment.

FIG. 80 show a crystal structure of CH235 antibody with a gp120 envelope, and a model of the CH235 UCA interaction a gp120 envelope with G458 and Y458. This figure shows one possible structural rationale for improved neutralization of the CH505 T/F G458Y mutant virus by the CH235 UCA. The figure shows that in the CH235 mature antibody gp120 complex, W50 in the CH235 CDRH2 pairs with the G458. Amino acid W is large, G458 is small. But for the CH235 UCA, it is I50 in the germline. The I50W is a mutation, and an extremely improbable one. I50 is much smaller than W. So in the CH235UCA/gp120 interaction, the pair is I50 (small) and G458 (small) which means contacts are disrupted. The G458Y mutation in the envelope acts to restore the pairing. So in the CH235UCA/gp120 interaction, I50 (small) is paired with Y458 (large).

Non-limiting example of additional possible mutations at position 458 are as follows:
G458F
G458W
G458M
G458Q
G458R (R is 2nd most frequent in LANL db)
G458K
G458H
G458N.

Without being bound by any specific theory, these mutations are expected to improve contacts like TYR at 458. These amino acid changes are selected based on size to increase potential contacts to I50 in CH235 UCA CDRH2.

Binding and/or affinity of antibodies to HIV-1 Env proteins G458Mut GnTI$^{-/-}$ cells produced, can be measured by any suitable method, for example but not limited to ELISA, SPR, and the like. See Example 1 and Example 8.

Any suitable GnTI–/– cell line could be use. See Bussow, K. in Current Opinion in Structural Biology 2015, 32:81-90; Chang et al. Structure. 2007 March; 15(3): 267-273. Glycosylation patterns of the envelopes produced in GnTI$^{-/-}$ cells could be determined by any suitable method.

References for Example 10

1. Pritchard L K, Spencer D I, Royle L, Bonomelli C, Seabright G E, Behrens A J, et al. Glycan clustering stabilizes the mannose patch of HIV-1 and preserves vulnerability to broadly neutralizing antibodies. Nat Commun. 2015; 6:7479. doi:10.1038/ncomms8479
2. Pritchard L K, Vasiljevic S, Ozorowski G, Seabright G E, Cupo A, Ringe R, et al. Structural constraints determine the glycosylation of HIV-1 envelope trimers. Cell Rep. 2015; 11:1604-1613. DOI: http://dx.doi.org/10.1016/j.celrep.2015.05.017
3. Doores K J, Bonomelli C, Harvey D J, Vasiljevic S, Dwek R A, Burton D R, et al. Envelope glycans of immunodeficiency virions are almost entirely oligomannose antigens. Proc Natl Acad Sci USA 2010; 107:13800-13805. doi: 10.1073/pnas.1006498107.
4. Go E P, Liao H X, Alam S M, Hua D, Haynes B F, Desaire H. Characterization of host-cell line specific glycosylation profiles of early transmitted/founder HIV-1 gp120 envelope proteins. J Proteome Res. 2013; 12:1223-1234. doi: 10.1021/pr300870t.
5. Gristick H B, Boehmer L v, West A P Jr, Schamber M, Gazumyan A, Golijanin J, et al. Natively glycosylated HIV-1 Env structure reveals new mode for antibody recognition of the CD4-binding site. Nature Structural & Molecular Biology. 2016; 23 (10): 906-915. doi:10.1038/nsmb.3291.

6. Zhu X, Borchers C, Bienstock R J, Tomer K B. Mass spectrometric characterization of the glycosylation pattern of HIV-gp120 expressed in CHO cells. Biochemistry. 2000; 39:11194-11204. PMID: 10985765
7. Behrens A-J, Vasiljevic S, Pritchard L K, Harvey D J, Andev R S, Krumm S A, et al. Composition and antigenic effects of individual glycan sites of a trimeric HIV-1 envelope glycoprotein. Cell Reports. 2016; 14:2695-2706. http://dx.doi.org/10.1016/j.celrep.2016.02.058
8. Binley J M, Ban Y E, Crooks E T, Eggink D, Osawa K, Schief W R, Sanders R W. Role of complex carbohydrates in human immunodeficiency virus type 1 infection and resistance to antibody neutralization. Journal of virology. 2010; 84:5637-5655. [PubMed: 20335257]
9. Reeves P J, Callewaert N, Contreras R, Khorana H G. Structure and function in rhodopsin: high-level expression of rhodopsin with restricted and homogeneous N-glycosylation by a tetracycline-inducible N-acetylglucosaminyltransferase I-negative HEK293S stable mammalian cell line. Proceedings of the National Academy of Sciences of the United States of America. 2002. 99:13419-13424. doi: 10.1073/pnas.212519299
10. Eggink D, Melchers M, Wuhrer M, van Montfort T, Dey A K, Naaijkens B A, et al. Lack of complex N-glycans on HIV-1 envelope glycoproteins preserves protein conformation and entry function. Virology. 2010; 401:236-247. doi: 10.1016/j.virol.2010.02.019
11. Mouquet H, Scharf L, Euler Z, Liu Y, Eden C, Scheid J F, et al. Complex-type N-glycan recognition by potent broadly neutralizing HIV antibodies. Proc Natl Acad Sci USA. 2012; 109:E3268-77. doi:10.1073/pnas.1217207109 PMID: 23115339; PubMed Central PMCID: PMCPMC3511153.
12. McGuire A T, Hoot S, Dreyer A M, Lippy A, Stuart A, Cohen K W, et al. Engineering HIV envelope protein to activate germline B cell receptors of broadly neutralizing anti-CD4 binding site antibodies. The Journal of Experimental Medicine. 2013; 210(4):655-63. Epub 2013/03/27. doi: 10.1084/jem.20122824 PMID: 23530120; PubMed Central PMCID: PMC3620356.
13. McGuire A T, Gray M D, Dosenovic P, Gitlin A D, Freund N T, Petersen J, et al. Specifically modified Env immunogens activate B-cell precursors of broadly neutralizing HIV-1 antibodies in transgenic mice. Nature Communications. 7:10618. doi: 10.1038/ncomms10618.
14. Zhou T, Georgiev I, Wu X, Yang Z Y, Dai K, Finzi A, et al. Structural basis for broad and potent neutralization of HIV-1 by antibody VRC01. Science. 2010; 329(5993): 811-817. doi: 10.1126/science.1192819 PMID: 20616231; PubMed Central PMCID: PMCPMC2981354.
15. Diskin R, Scheid J F, Marcovecchio P M, West A P, Klein F, Gao H, et al. Increasing the potency and breadth of an HIV antibody by using structure-based rational design. Science. 2011; 334 (6060):1289-93. doi: 10.1126/science.1213782 PMID: WOS:000297553600054.
16. Li Y, O'Dell S, Walker L M, Wu X, Guenaga J, Feng Y, et al. Mechanism of neutralization by the broadly neutralizing HIV-1 monoclonal antibody VRC01. J Virol. 2011; 85:8954-8967. http://dx.doi.org/10.1128/JVI.00754-11.
17. Kong R, Xu K, Zhou T, Acharya P, Lemmin T, Liu K, et al. Fusion peptide of HIV-1 as a site of vulnerability to neutralizing antibody. Science. 2016; 352:828-833. [doi: 10.1126/science. aae0474.
18. Liao H X, Lynch R, Zhou T, Gao F, Alam S M, Boyd S D, et al. Co-evolution of a broadly neutralizing HIV-1 antibody and founder virus. Nature. 2013; 496(7446): 469-76. doi: 10.1038/nature12053 PMID:23552890; PubMed Central PMCID: PMCPMC3637846.
19. Gao F, Bonsignori M, Liao H X, Kumar A, Xia S M, Lu X, et al. Cooperation of B cell lineages in induction of HIV-1-broadly neutralizing antibodies. Cell. 2014; 158 (3):481-91. doi: 10.1016/j.cell.2014.06.022 PMID: 25065977; PubMed Central PMCID: PMC4150607.
20. Lynch R M, Wong P, Tran L, O'Dell S, Nason M C, Li Y, Wu X, Mascola J R. HIV-1 fitness cost associated with escape from the VRC01 class of CD4 binding site neutralizing antibodies. J Virol. 2015; 89:4201-13. doi: 10.1128/JVI.03608-14. Epub 2015 Jan. 28.

Example 10

TABLE 20

Characterization of the neutralization properties of 426c, 426c.SM (N276D), 426c.DM (N460D/N463D) and 426c.TM (N276D/N460D/N463D) produced in either 293T cells or 293s/GnTI$^{-/-}$ cells (Man5-enrichment).

| | | ID50/IC50 in TZM-bl | | | | ID50/IC50 in TZM-bl | | | |
| --- | --- | --- | --- | --- | --- | --- | --- | --- | --- |
| Reagent | Epitope | 426c | 426c.SM | 426c.DM | 426c.TM | 426c/GnTI | 426c.SM GnTI | 426C.DM GnTI | 426c.TM GnTI |
| CHAVI-0406 | Polyclonal | 20 | 20 | 20 | 86 | 172 | 201 | 230 | 338 |
| CHAVI-0060 | Polyclonal | 40 | 31 | 31 | 52 | 100 | 144 | 95 | 338 |
| CHAVI-0642 | Polyclonal | 55 | 68 | 51 | 129 | 282 | 339 | 169 | 519 |
| CHAVI-0293 | Polyclonal | 20 | 20 | 20 | 113 | 26 | 45 | 42 | 543 |
| CHAVI-0585 | Polyclonal | 199 | 264 | 225 | 451 | 963 | 1544 | 1152 | 3011 |
| GMT | | 45 | 47 | 43 | 124 | 165 | 234 | 178 | 627 |
| 2219 | V3 | >25 | >25 | >25 | >25 | >25 | >25 | >25 | >25 |
| 2557 | V3 | >25 | >25 | >25 | >25 | >25 | >25 | >25 | >25 |
| 3074 | V3 | >25 | >25 | >25 | >25 | >25 | 23 | >25 | >25 |
| 3869 | V3 | >25 | >25 | >25 | >25 | >25 | >25 | >25 | >25 |
| 447-52D | V3 | >25 | >25 | >25 | >25 | >25 | >25 | >25 | >25 |
| 838-12D | V3 | >25 | >25 | >25 | >25 | >25 | >25 | >25 | >25 |
| 830A | V2 | >25 | >25 | >25 | >25 | | | | |
| 654-30D | CD4bs | >25 | >25 | >25 | >25 | >25 | >25 | >25 | >25 |
| 1008-30D | CD4bs | >25 | >25 | >25 | >25 | >25 | >25 | >25 | >25 |
| 1570D | CD4bs | >25 | >25 | >25 | >25 | >25 | >25 | >25 | >25 |
| 729-30D | CD4bs | >25 | >25 | >25 | >25 | >25 | >25 | >25 | >25 |
| F105 | CD4bs | >25 | >25 | >25 | >25 | >25 | >25 | >25 | >25 |
| HJ16 | CD4bs | >25 | >25 | >25 | >25 | >25 | >25 | >25 | >25 |
| sCD4 | CD4bs | >25 | >25 | >25 | 20.2 | >25 | 24 | 23 | 23 |
| 2G12 | glycan | >25 | >25 | >25 | >25 | >25 | >25 | >25 | >25 |

TABLE 20-continued

Characterization of the neutralization properties of 426c, 426c.SM (N276D), 426c.DM (N460D/N463D) and 426c.TM (N276D/N460D/N463D) produced in either 293T cells or 293s/GnTI$^{-/-}$ cells (Man5-enrichment).

| Reagent | Epitope | ID50/IC50 in TZM-bl | | | | ID50/IC50 in TZM-bl | | | |
|---|---|---|---|---|---|---|---|---|---|
| | | 426c | 426c.SM | 426c.DM | 426c.TM | 426c/GnTI | 426c.SM GnTI | 426C.DM GnTI | 426c.TM GnTI |
| 2F5 | MPER | >25 | >25 | >25 | >25 | >25 | >25 | >25 | >25 |
| 4E10 | MPER | 3.32 | 1.52 | 1.00 | 0.98 | 4 | 3.8 | 3.7 | 4 |
| DH511.2_K3 | MPER | 0.8 | 0.77 | 1.50 | 1.06 | 0.85 | 0.87 | 0.75 | 1.2 |
| CH01 | V2-gly | >25 | >25 | >25 | >25 | >25 | >25 | >25 | >25 |
| PG9 | V2-gly | >5 | >5 | >5 | >5 | >5 | >5 | >5 | >5 |
| PG16 | V2-gly | >5 | >5 | >5 | >5 | >5 | >5 | >5 | >5 |
| PGDM1400 | V2-gly | >25 | >25 | >25 | >25 | >5 | >5 | >5 | >5 |
| PGT121 | V3-gly | >5 | >5 | >5 | >5 | 2.5 | 4.2 | 3.4 | 3.4 |
| PGT128 | V3-gly | >5 | >5 | >5 | >5 | 4.3 | >5 | >5 | >5 |
| 10-1074 | V3-gly | 0.05 | 0.12 | 0.10 | 0.16 | 0.03 | 0.04 | 0.03 | 0.03 |
| PGT151 | gp120/gp41 | 0.01 | 0.01 | 0.01 | 0.01 | 1.6 | 1.9 | 2.2 | 2.5 |
| VRC34.1 | gp120/gp41 | 0.08 | 0.06 | 0.09 | 0.08 | 0.05 | 0.07 | 0.04 | 0.07 |
| IgG1b12 | CD4bs | >25 | >25 | >25 | >25 | >25 | >25 | >25 | >25 |
| VRC01 | CD4bs | 2.20 | 0.39 | 0.41 | 0.03 | 0.19 | 0.04 | 0.04 | 0.015 |
| 3BNC117 | CD4bs | 0.20 | 0.24 | 0.13 | 0.01 | 0.02 | 0.01 | 0.006 | 0.003 |
| VRC-CH31 | CD4bs | 0.62 | >25 | 0.73 | >25 | 0.04 | 0.7 | 0.02 | 1.6 |
| CH103 | CD4bs | >40 | >40 | 6.1 | 5.2 | 5.3 | 2.2 | 0.63 | 0.09 |
| DH235 | CD4bs | >50 | >50 | >50 | >50 | >25 | >25 | >25 | >25 |

Example 10

TABLE 21

Enhanced detection of neutralizing activity by early intermediates of the CH103 and CH235 lineages of CD4bs bNAbs. Glycan positions deleted: CH0505TF.gly4 (197, 461/462, 276, 362); CH0505TF.gly3.197 (461/462, 276, 362); CH0505TF.gly3.276 (197, 461/462, 362); CH0505TF.gly3.461 (197, 276, 362). Env-pseudotyped viruses were produced in either 293T cells or 293S/GnTI−/− cells (Man5-enrichment).

| | IC50 (ug/ml) in TZM-bl cells | | | | | |
|---|---|---|---|---|---|---|
| Reagent | CH0505TF/ 293T ID#5444 | CH0505TF/ GnTI$^{-/-}$ ID#7309 | CH0505TF.gly4/ 293T ID#7691 | CH0505TF.gly4/ GnTI$^{-/-}$ ID#7698 | CH0505TF.gly3.197/ 293T ID#7693 | CH0505TF.gly3.197/ GnTI$^{-/-}$ ID#7701 |
| VRC01 | 0.09 | 0.03 | 0.002 | 0.001 | 0.023 | 0.009 |
| VRC01/ gHvgLv | >50 | >50 | 26.4 | >50 | >50 | >50 |
| CH103_UCA1.1_4A | >50 | >50 | >50 | 6.4 | >50 | >50 |
| CH103_UCAGrand5 | >50 | >50 | >50 | >50 | >50 | >50 |
| CH103_IA_9_4A | >50 | >50 | >50 | >50 | >50 | >50 |
| CH103_IA_8_4A | 25.2 | 0.52 | 0.004 | 0.001 | 8.5 | 0.14 |
| CH103_IA_7_4A | 4.7 | 0.072 | 0.002 | 0.001 | 5.9 | 0.02 |
| CH103_IA_6_4A | >50 | 5.5 | 0.001 | 0.001 | >50 | 2.2 |
| CH103_IA_5_4A | 7.6 | 0.54 | 0.001 | 0.002 | 2.8 | 0.48 |
| CH103_IA_4_4A | 3.2 | 0.15 | 0.002 | 0.001 | 0.97 | 0.035 |
| CH103_4A (Mature) | 2.6 | 0.67 | 0.01 | 0.005 | 1.6 | 0.19 |
| CH235UCA_LL | >50 | >50 | >50 | >50 | >50 | >50 |
| CH235UCAtk_v2_4A/ 293i | >50 | >50 | >50 | >50 | >50 | >50 |
| CH235_I4_v2_4A/ 293i | >50 | 1.4 | >50 | >50 | >50 | >50 |
| CH235_I3_v2_4A | 5.3 | 0.1 | 17.7 | 0.8 | >50 | 0.018 |
| CH235VH_I1_v2_4A/ 293i | 0.85 | 0.05 | 0.83 | 0.24 | 1.8 | 0.022 |
| CH235_4A (mature) | 0.35 | 0.03 | 0.022 | 0.004 | 0.16 | 0.006 |

Example 10

TABLE 22

Neutralization of CH0505TF by UCAs and early intermediates of CH235 is dependent on G458Y and Man5-enrichment (GnTI$^{-/-}$).

| | IC50 (µg/ml) in TZM-bl | | | |
|---|---|---|---|---|
| Antibody | CH0505TF 293T | CH0505TF.G458Y 293T | CH0505TF GnT$^{-/-}$ | CH0505TF.G458Y GnTI$^{-/-}$ |
| CH235UCA_LL | >50 | >50 | >50 | 0.03 |
| CH235UCAtK_v2_4A/293i | >50 | >50 | >50 | 0.8 |
| CH235UCALRLL_V3_4/293i | >25 | >25 | >25 | 0.16 |
| CH235_I4_v2_4A/293i | >50 | >50 | 1.4 | 0.08 |
| CH235_I3_v2_4A | 5.3 | 0.99 | 0.12 | 0.03 |
| CH23SVH_I1_v2_4A/293i | 0.85 | 0.14 | 0.1 | <0.02 |
| CH235_4A (mature) | 0.35 | 0.2 | <0.02 | <0.02 |

For CH235 UCA Nomenclature see Example 13. Sequences of Different CH235UCAs are Referenced in Example 8 and Shown in FIGS. 59A and 59B.

Example 11

Envelope Modifications that Permit Neutralization of HIV-1 by Germline-Reverted Forms of Broadly Neutralizing Antibodies to the CD4 Supersite The ability to stimulate germline B cells that give rise to broadly neutralizing antibodies (bNAbs) is a major goal for HIV-1 vaccine development. BNAbs that target the CD4-binding site (CD4bs) of HIV-1 and exhibit extraordinary potency and breadth of neutralization are particularly attractive to elicit with vaccines. Glycans that border the CD4bs and impede the binding of germline-reverted forms of CD4bs bNAbs are potential barriers to naïve B cell receptor engagement. Targeted deletion of a subset of these glycans by sequon mutation has permitted binding but not neutralization, suggesting additional barriers exist. We produced HIV-1 in cells lacking the enzyme N-acetylglucosaminyl-transferase (GnTI-) to enrich for Man5 glycoforms of N-linked glycans that would otherwise be processed into complex-type glycans. Our rationale was that small Man5 would replace larger complex-type glycans to further reduce steric barriers to germline CD4bs bNAb binding without disrupting native Env conformation. Targeted glycan-deleted HIV-1 produced in GnTI-cells was infectious and susceptible to potent neutralization by several germline-reverted VRC01-class bNAbs; neither glycan modification alone was sufficient for neutralization. Neutralization also was observed for germline-reverted and early intermediates of CH235/CH235.12 (VH1-46) and CH103 (VH4-59). Neutralization by germline-reverted CH235/CH235.12 required both Man5 enrichment and mutation of G458 in the V5 region of gp120 without targeted glycan deletion. These findings advance our understanding of the restrictions imposed by glycans in the elicitation of CD4bs bNAbs and provide a conceptual framework for improved vaccine designs.

Summary

Induction of broadly neutralizing antibodies (bNAbs) is a high priority for HIV-1 vaccines. Although these antibodies are made in HIV-1-infected individuals, it has not been possible to induce them with current vaccine immunogens. One reason for this is that the immunogens are not able to engage appropriate germline B cells to initiate the response. Here we show that glycans on the HIV-1 envelope can be modified in ways that should allow the envelope to stimulate germline B cells that give rise to a class of bNAbs targeting the CD4-binding site (CD4bs) of envelope gp120. These modifications involve the removal of select glycans, together with changes in the composition of other glycans, with the aim of exposing the CD4bs in a native conformation. An additional modification involves a glycine to tyrosine mutation (G458Y) in the CD4bs of gp120, which does not alter glycan composition. Inferred germline and early intermediates of certain CD4bs bNAbs exhibited neutralizing activity only when targeted glycan removal, or the G458Y mutation, was combined with an enrichment of Man5 glycoforms on HIV-1 Env-pseudotyped viruses. Our findings suggest that such modifications, and reverse-engineered versions of them, have potential to initiate and mature CD4bs bNAb responses.

Introduction

The CD4-binding site (CD4bs) of HIV-1 envelope glycoproteins (Env) is essential for virus entry [1] and is susceptible to some of the most potent broadly neutralizing antibodies (bNAbs) described to date, neutralizing up to 98% of circulating strains [2-10]. These bNAbs also prevent and SHIV infection in nonhuman primates [11-16] and produce transient reductions in plasma viremia in infected humans [17, 18] and macaques [19, 20]. Such features make CD4bs bNAbs highly attractive for vaccine development. Unfortunately, although the human immune system is clearly capable of making these antibodies in the setting of chronic infection, all efforts to elicit them with vaccines in non-human primates and humans have failed [21].

A major roadblock is the high levels of somatic hyper-mutation required to bind an epitope that is conformationally masked and sterically occluded by surrounding glycans [7, 9, 22, 23]. Mature CD4bs bNAbs resemble CD4 in their mode of binding and contact the CD4-binding loop while avoiding or accommodating potential clashes with loop D and the fifth variable (V5) regions of gp120, often contacting both of these latter regions [2, 22, 24]. Few immunoglobulin gene families appear to give rise to CD4bs bNAbs, most notably VH1-2 and the closely related VH1-46, both of which are utilized by the most potent CD4bs bNAbs (e.g., VRC01, 3BNC117, N6, CH235.12). Binding of these bNAbs is mediated by the heavy and light chains and is dominated by the heavy-chain second complementarity determining region (CDRH2) when either VH1-2 or VH1-46 are utilized [2, 5, 10]. Other CD4bs bNAbs (e.g., CH103, VRC13, VRC16 and HJ16) make use of multiple additional VH gene families, and their binding involves a CDRH3-dominated mode of recognition [6, 10].

Part of the reason why current immunogens fail to induce these bNAbs is that they do not bind germline-reverted forms of CD4bs bNAbs [7, 9, 22, 25-29] and therefore are unlikely to engage cognate naïve B cell receptors (BCRs). Weak germline binding has been detected against autologous Envs but it is not clear that this weak binding will provide an adequate stimulus to naïve B [30, 31].

Relationships between antibody structure and function are serving as a basis to reverse-engineer improved germline-targeting immunogens for the VRC01 class of CD4bs bNAbs. Notably, germline-reverted forms of these bNAbs are less positively charged [32] and their CDRH3 might play a more dominant role [33] than the mature bNAbs; both of these features could potentially influence interactions with complex-type glycans. Germline binding has been detected by introducing Env mutations that selectively remove glycans in the vicinity of the CD4bs that are predicted to clash with germline forms of the bNAbs. Targeted removal of three glycans from clade C strain 426c gp140ΔV1-V3, one at N276 in loop D that contacts the light chains of VRC01 and NIH45-46 [22, 34], and two at N460 and N463 in V5 that modulate VRC01 sensitivity [35], permit nanomolar affinity binding of germline-reverted forms of VRC01 and NIH45-46 [27]. These mutations also permit activation of B cells expressing germline-reverted BCRs of VRC01 and NIH45-46 in vitro [27], and they activate germline-reverted BCR of 3BNC60 in transgenic mice [36]. Deletion of glycan N276 is also one central design feature of engineered outer domain, germline-targeting (eOD-GT) immunogens that bind germline forms of the VRC01 class of bNAbs and activate germline-reverted BCR in knock-in mice [26, 37, 38].

HIV-1 Env is one of the most heavily glycosylated proteins known, with a glycan content that accounts for approximately 50% of its molecular mass [39]. A majority of these glycans exist as under-processed Man5-9GlcNac2 glycoforms owing to steric constrains imposed by the dense clustering of glycans and the trimerization of gp120-gp41 heterodimers that impede the actions of α-mannosidases required for complex glycan formation [40-43]. A predominance of high mannose glycans is seen with multiple forms of Env produced in different cell types [44-51], where a higher abundance of Man5GlcNac2 is present on virions and membrane associated Env than on recombinant gp120 and gp140 proteins [40, 44, 47]. The smaller proportion of fully processed glycans exists mainly as sialylated bi-, tri- and tetra-antennary complex-type glycans [4, 47, 52, 53], a portion of which surround the CD4bs [4, 54].

Complex-type glycans are arrested at Man5GlcNac2 in the absence of the enzyme N-acetylglucosaminyltransferase (GnTI) [55], which is responsible for attachment of GlcNAc to Man5GlcNAc2 in the medial-Golgi as a requisite step for complete processing. There is at least one report of improved neutralization potency of mature CD4bs bNAbs against Envs produced in GnTI-cells [56]. Here we converted complex-type glycans into smaller Man5GlcNAc2 in the context of other Env modifications to reduce steric barriers to germline bNAbs without disrupting native Env conformation. We examined this by requiring neutralization of Env-pseudotyped viruses as proof germline bNAb engagement of native functional Env.

Results

Enhanced neutralization potency of mature CD4bs bNAbs against Envs produced in GnTI-cells Multiple BNAbs were assessed for neutralizing activity against Env-pseudotyped viruses produced in either 293T or 293S GnTI-cells. The latter cells were used to generate Man5-enriched Env, with the rationale that relatively small Man5 would replace larger complex-type glycans that contribute to CD4bs masking. Initially, three mature CD4bs bNAbs (VRC01, 3BNC117 and VRC-CH31) were assayed against Envs from strains CE1176 and WITO. Greater potency (often >10-fold) was seen against GnTI-Envs for all three bNAbs (FIG. 84A). A third Env, TRO.11, was assayed with a wider range of mature bNAbs covering multiple epitopes (FIG. 84B). With the exception of IgG1b12 and HJ16, the CD4bs bNAbs again showed enhanced potency against GnTI-Env. HJ16 was less potent against GnTI-Env, while IgG1b12 was non-neutralizing. HJ16 requires gp120 glycan N276 [57], and it is possible that occupation of this site by Man5GlcNAc2 is not tolerated by HJ16. GnTI- had little or no impact on bNAbs to epitopes outside the CD4bs. Notably, no neutralization was detected with germline-reverted forms of CD4bs bNAbs (FIG. 84A).

Complementarity of Man5-enrichment and targeted glycan deletion for neutralization by mature CD4bs bNAbs We next examined a combination of GnTI-production and targeted deletion of one or more glycans surrounding the CD4bs. Mutants of 426c Env were used that lacked glycan N276 (426c.SM), two glycans at N460 and N463 (426c.DM), or all three glycans (426c.TM) [27]. A fourth mutant, 426c.TM4, lacked all three glycans except that glycan N276 was removed by introducing S278R [36]. TM4 also contained a G471S mutation that facilitates germline bNAb binding to eOD-GT6 [26].

The glycan-deleted Envs, whether produced in 293T or GnTI-cells, maintained a tier 2 neutralization phenotype with HIV-1 sera and were mostly resistant to mAbs that preferentially neutralize Tier 1 Envs (non-neutralizing Abs) (Table 24). Envs produced in GnTI-cells were more sensitive to HIV-1 sera than their 293T-grown counterpart, especially the TM and TM4 mutants, but still within the Tier 2 spectrum.

As reported previously for NIH45-46 [27], glycan deletion increased the susceptibility of 426c Env to neutralization by mature CD4bs bNAbs when the virus was produced 293T cells (Table 24, FIG. 85A). VRC01 and 3BNC117 were ~10-1000 times more potent against TM and TM4 compared to parental 426c Env. CH103 exhibited moderately improved potency against DM, TM and TM4. VRC-CH31 exhibited moderately improved potency against TM4 but was knocked-out by SM and TM, demonstrating a dependency on glycan N276. All 426c Envs produced in 293T cells were resistant to CH235 but were sensitive to CH235.12. (Table 24). Despite 100-fold and 1000-fold improved potencies of mature VRC01 against 293T versions of TM and TM4, respectively, no neutralization of these Envs was detected with germline-reverted VRC01 (Table 24), which agrees with an earlier report [27].

GnTI-production enhanced the susceptibility of parental 426c Env to neutralization by mature VRC01, 3BNC117, VRC-CH31 and CH103 compared to when the Env was produced in 293T cells, and this susceptibility was further enhanced against one or more glycan-deleted variants of 426c Env, demonstrating the complementary nature of glycan deletion and GnTI-production for these mature bNAbs (FIG. 85A and Table 24). In contrast, GnTI-production reduced the susceptibility of parental, DM and TM4 Envs to neutralization by CH235.12 and had little impact on the SM and TM Envs in this case. GnTI-production had little or no impact on most other mature bNAbs tested (Table 24). A notable exception was a ~100-fold diminished potency of PGT151 (gp120-gp41 epitope), which agrees with previous findings that PGT151 preferentially binds complex-type glycans in microarrays [58] and binds poorly to Env trimers containing only high mannose glycans [59]. GnTI-production had no measurable impact on VRC34.01, whose epitope overlaps but is distinct from that of PGT151 [60].

Neutralization by germline-reverted forms of VRC01-class bNAbs requires a combination of Man5-enrichment and targeted glycan deletion Germline-reverted and early intermediates of CD4bs bNAbs were evaluated for an ability to neutralize GnTI-version of targeted glycan deleted 426c Envs. These tests included near-germline forms of several VRC01-class bnAbs, which possess a mature HCDR3 region for which the germline form could not be inferred with existing sequences. They also included fully reverted germline forms of VRC-CH31, CH103 and CH235/CH235.12. Mature CH235 and CH235.12 are members of the same lineage and exhibit 18% and 90% neutralization breadth, respectively, against a multiclade panel of 199 viruses [2]. Their unmutated common ancestor (UCA) is referred to here as CH235 UCA2.

GnTI-versions of the 426c SM, TM and TM4 Envs were remarkably sensitive to neutralization by germline-reverted VRC01, with IC50s of 0.99, 2.5 and 0.44 µg/ml, respectively (FIG. 85B, Table 24). Germline-reverted VRC01 did not neutralize the 293T versions of these Envs, although a positive deflection was seen against the 293T version of TM4 at the highest antibody concentrations tested. No neutralization was detected against parental 426c Env produced in either cell type. Thus, germline-reverted VRC01 neutralizes 426c when the Env is both Man5-enriched and lacking glycan N276. This impact of glycan N276 agrees with the observation that germline reverted VRC01 binds gp140 trimers of 426c.SM and 426c.TM but not 426c.DM (N276 glycan present) produced in 293T cells [27]. It has been suggested that germline VRC01 recognizes viruses lacking glycan N276 and that accommodating this glycan leads to breadth [61]. Our results are consistent with this and suggest that Man5 enrichment will further improve germline binding.

Germline forms of other VRC01-class bNAbs also neutralized GnTI-versions of the TM and TM4 Envs (FIG. 86A). Here, TM was neutralized by germline forms of VRC07 (IC50=1.6 µg/ml), VRC20 (IC50=4.6 µg/ml) and VRC18 (IC50=23 µg/ml). TM4 was neutralized by germline forms of VRC07 (IC50=1.7 µg/ml), VRC18 (IC50=17.3 µg/ml), VRC20 (IC50=0.03 µg/ml), and 12A12 (IC50=0.63 µg/ml). Thus, 426c.TM and TM4 Envs produced in GnTI-cells are targets for neutralization by some but not all germline-reverted forms of VRC01-class bNAbs. In order to map this activity in sera from vaccine recipients, a known VRC01 resistance mutation, D279K [61], was introduced into 426c.TM. The GnTI-version of 426c.TM.D279K Env was highly resistant to germline forms of VRC01, VRC07 and VRC20 (FIG. 86B), indicating utility for diagnostic epitope mapping.

Attempts were made to detect neutralization by germline reverted and intermediates of the VRC01-like bNAb, VRC-CH31. Here, 426c.DM was used because the absence of glycan N276 in the single and triple glycan mutant Envs renders 426c resistant to mature VRC-CH31 (FIG. 85A, Table 24). No neutralizing activity was detected with the germline-reverted antibody regardless of the Env used; however all four VRC-CH31 intermediates neutralized 293T versions of 426c and 426c.DM Envs (FIG. 87), with the double mutant being slightly more sensitive than parental Env. These intermediates exhibited far greater potency (>10-fold) when 426c.DM Env was produced in GnTI-cells (FIG. 87), suggesting that the GnTI-version of this Env may provide an advantage for engaging and detecting early intermediates of this lineage.

Neutralization by Germline-Reverted CH103 and Intermediates of CH103 and CH235

The lack of susceptibility of Man5-enriched versions of glycan-deleted 426c Envs to neutralization by germline-reverted and intermediates of CH103 and CH235 (Table 24) led us to test glycan-deleted variants of the autologous transmitted/founder Env (CH0505TF) that evolved and gave rise to CH103 and its CH235-helper lineage [6, 30]. One CH0505TF mutant lacked four glycans at N197, N461/462, N276 and N362 (gly4), whereas the others lacked three glycans by adding back glycans N197 (gly3.197), N276 (gly3.276) or N461 (gly3.461) [62]. CH0505TF naturally lacks glycan N362.

As reported previously [62], 293T versions of parental CH0505TF and all four glycan mutants were sensitive to mature CH103, CH235 and CH235.12, with the gly4, gly3.276 and gly3.461 Envs often being 10-1000 times more sensitive than the parental and gly3.197 Envs (FIG. 88, Table 24). The 293T versions of gly4, gly3.276 and gly3.461 Envs also were very sensitive to neutralization by intermediates of CH103 and moderately sensitive to neutralization by the two later intermediates of CH235. GnTI-production generally increased these levels of neutralization against parental CH0505TF and all four glycan mutant Envs (FIG. 88, Table 25).

Notably, GnTI-versions of the gly4 and gly3.461 Envs were moderately sensitive to neutralization by germline-reverted CH103 (IC50=6.4 and 10.2 µg/ml, respectively), whereas 293T versions of these Envs were not neutralized (FIG. 88A). GnTI-production also enabled neutralization of parental CH0505TF Env by the earliest intermediate of CH235 tested (CH23514.v2.4A, IC50=1.4 µg/ml), which was not neutralized when the Env was produced in 293T cells (FIG. 88B). The glycan mutant Envs, whether produced in 293T or GnTI-cells, were highly sensitive to intermediates of VRC-CH31 (Table 25), and this sensitivity exceeded that seen with glycan mutants of Env 426c (Table 24). Overall these results indicate an advantage of using engineered CH0505TF rather than 426c Env to detect germline-reverted CH103 and intermediates of CH103, CH235/CH235.12 and VRC-CH31. Despite this advantage, the modified CH0505TF Envs did not permit neutralization by germline-reverted VRC01, VRC-CH31 or CH235/CH235.12 (CH235 UCA2) (Table 25).

Neutralization by CH235 UCA2 Requires a Combination of Man5-Enrichment and Mutation of G458 in gp120

We were interested in developing diagnostic mutants to map the neutralizing activity detected with intermediates of the CH103 and CH235 lineages. Two known CD4bs bNAb resistance mutations, N280D (loop D) and G458Y (V5 proximal), were introduced into CH0505TF and assayed as 293T-produced Envs against a panel of mature bNAbs (Table 23). N280D and G458Y were strong resistance mutations for VRC01 and 3BNC117. N280D was a strong resistance mutation for CH235, N6 and VRC-CH31. Neither mutation had a strong impact on CH103, although a 3-fold reduction in neutralization was seen with G458Y. To design a better resistance mutation for CH103, additional point mutations were investigated that in crystal structures are contacts for CH103 but not CD4 (to maintain infectivity). Three mutations in V5 (N461A, N462A and T463A) had no effect but a fourth mutation in the CD4-binding loop (S365P) conferred resistance to CH103 (Table 23). The S365P mutation also conferred partial resistance to VRC-CH31 (Table 23). No mutation reduced the neutralizing activity of CH235.12.

The N280D, G458Y and S365P mutants of CH0505TF were used as GnTI-Envs for mapping (Table 23 and Table 25). S365P was an effective resistance mutation for CH103 intermediates but was only modestly effective for mature CH103. G458Y conferred partial resistance to CH103 intermediates (more complete resistance was seen with the 293T version of this mutant Env, Table 25). N280D was an effective resistance mutation for the one intermediate and two mature forms of CH235 that neutralized the parent virus.

Surprisingly, the G458Y mutation in the context of CH0505TF Env produced in GnTI-cells conferred a high level of susceptibility to neutralization by CH235 UCA2 and all intermediates of this lineage (FIG. 89A, Table 25). This was unexpected for a mutation that confers resistance to other CD4bs bNAbs [61, 63-67]. CH235 UCA2 did not neutralize the 293T version of CH0505TF.G458Y Env (Table 25). It also failed to neutralize 293T and GnTI-versions of glycan-deleted CH0505.gly4.G458Y Env (Table 26), which in the absence of the G458Y mutation was at least 10× more sensitive to mature CH235 and CH235.12 than parental CH0505TF Env (Table 25). These observations demonstrate that germline reverted and intermediates forms of CH235/CH235.12 strongly recognize native functional CH0505TF Env that contains a tyrosine (Y) at position 458 and is produced in GnTI-cells. Either Env modification alone was not sufficient. Moreover, deletion of three glycans surrounding the CD4bs was detrimental.

Additional amino acid substitutions at position 458 were tested for an effect similar to tyrosine. CH0505TF Env was sensitive to neutralization by CH235 UCA2 when position 458 was occupied by phenylalanine (F), tryptophan (W), arginine (R), cysteine (C) and leucine (L), although tyrosine remained superior (FIG. 89A, Table 27). Only minor positive deflections were detected when the position was occupied by lysine (K), serine (S), aspartic acid (D) or glutamic acid (E), the latter two amino acids being the only ones that are negatively charged (FIG. 89A, Table 27). Sensitivity to CH235 UCA2 corresponded to heightened sensitivity to intermediates and mature forms of CH235 (Tables 25 and 27). No substitution substantially altered the neutralization phenotype with HIV-1 sera, although G458D was moderately more sensitive (Table 27). Neutralization of the GnTI-version of CH0505TF.G458Y Env by UCA2 and intermediates of CH235 was negatively impacted by N280D, indicating diagnostic utility for mapping (Table 27).

To gain insight into the G458Y impact on CH235 UCA2, the crystal structure of gp120 in complex with CH235 [2] was examined. As shown in FIG. 89C, glycine G458 in the V5 region of gp120 contacts the aromatic rings of tryptophan (W50) in the CDRH2 of mature CH235. This position in UCAs is isoleucine (I50), which when structurally modeled into the crystal structure is too small to make interfacial contacts with G458. Based on structural modeling, we hypothesize that replacing the small glycine residue with tyrosine (Y458), which has a bulky aromatic side chain, could allow for increased hydrophobic contacts and thus more favorable binding between the UCA and the G458Y mutant gp120. Indeed, amino acid hydrophobicity at the G458 position was correlated with UCA2 neutralization of the mutant viruses (FIG. 89B) suggesting that filling the cavity within the gp120-UCA2 interface at position 458 with hydrophobic residues could be a potential structural mechanism for attaining UCA2 neutralization.

We asked whether CH0505TF.G458Y GnTI-Env existed in a more open trimer conformation that is associated with a highly sensitive Tier 1 neutralization phenotype [68-70]. The GnTI-version of CH0505TF.G458Y Env was only 3 times more sensitive to HIV-1 sera than the parental Env grown in either GnTI- or 293T cells (Table 25). It was also resistant to a panel of antibodies that show preference for Tier 1 Envs (non-neutralizing Abs in Table 25). Moreover, the GnTI-version of a highly neutralization sensitive Tier 1 variant of CH0505TF Env (CH0505.w4.3) was not neutralized by CH235 UCA2, and was not more sensitive to the intermediates and mature forms of CH235 compared to the GnTI-version of parental CH0505TF Env (Table 25). Overall, the structural determinants that permit neutralization of Man5-enriched CH0505TF.G458Y Env by CH235 UCA2 may be less subtle than the open trimer conformation that leads to a Tier 1 neutralization phenotype.

Discussion

Part of the reason why current vaccine immunogens fail to induce bNAbs is that they are unable to stimulate appropriate germline-encoded B cell receptors. To overcome this limitation, researchers are identifying natural and engineered Env proteins that bind germline-reverted forms of the bNAbs as partial mimics of the naïve B cell receptors [6, 26, 27, 36-38]; such proteins are in early stages of development and it is unclear whether they will initiate correct antibody lineages in humans and wild-type animal models. We sought Env modifications that would permit neutralization by germline forms of CD4bs bNAbs as stringent proof of native envelope engagement by the antibodies. One previous report described weak neutralization by germline-reverted CH103 against an early autologous Tier 1 Env [30], which was also observed here (IC50=24 µg/ml, Table 25). Another report described neutralization of 426c.SM and TM by VRC01-class bNAb NIH45-46 but only at high antibody concentrations (IC50~100 µg/ml) [27]. We describe Env modifications that permit far greater neutralization potency by germline forms of several CD4bs bNAbs, including VRC01-class (VH1-2) (IC50=0.03 µg/ml), CH235/CH235.12 (VH1-46) (IC50=0.16 µg/ml), and to a lesser extent CH103 (VH4-59) (IC50=6.4 µg/ml). This was accomplished by using either targeted glycan deletion or mutation of gp120 position 458, combined with Man5-enrichment of N-linked glycans that would otherwise be fully processed into complex-type glycans.

Man5-enrichment in GnTI-cells was hypothesized to reduce steric barriers to germline bNAb binding without disrupting native Env conformation. That Man5-enriched Envs were infectious is consistent with previous reports [45, 54] and indicates that native conformation was indeed preserved. Several mature CD4bs bNAbs were more potent against Man5-enriched Envs than wild type Envs, while most bNAbs to epitopes outside the CD4bs were not affected (Tables 24 and 25). One exception is PGT151 (gp120-gp41 epitope), which was negatively impacted by Man5-enrichment. This agrees with previous indications that PGT151 requires one or more complex-type glycans [58, 59]. Another exception was the increased potency of V2-apex bNAbs CH01 and PG9 against glycan-deleted, Man5-enriched variants of CH0505TF (Table 25). Further studies are warranted to determine whether Man5-enrichment might be a viable approach to initiate V2-apex bNAbs.

It was necessary to couple Man5-enrichment with targeted glycan deletion in 426c Env to achieve neutralization by germline-reverted forms of VRC01-class bNAbs. A simple explanation for why both modifications were necessary is that not all complex-type glycans acting as steric barriers to germline binding were removed by targeted deletion. Indeed, the lower glycan density created by targeted sequon removal has potential to relieve steric constraints on α-mannosidases and result in an increased number of fully processed complex-type glycans [40-43]. Any additional complex-type glycans generated in this way should remain arrested as smaller Man5 glycoforms when produced in GnTI-cells, thereby affording a lower barrier to germline binding.

A remarkable finding was that mutation of G458 in the V5 region of gp120 (a CD4 contact residue) enabled germline-reverted and several intermediates of CH235/CH235.12 to potently neutralize Man5-enriched CH0505TF Env. Y458 was most effective but other amino acids also permitted neutralization. Mutation of this site, usually to negatively charged aspartic acid (G458D), confers resistance to certain VRC01-class bNAbs [61, 63-67] and was shown here as a G458Y mutation to confer resistance to VRC01 and 3BNC117. Neutralization by germline-reverted and early intermediates of CH235/CH235.12 required both Man5-enrichment and mutation of G458 without the need for targeted glycan deletion. At the molecular level, G458Y mutation restores a potential contact site in the CDRH2 region of germline-reverted CH235/CH235.12 that is lost when a tryptophan (W50) in the mature CDRH2 is reverted to isoleucine in the UCA. Since G458 is highly conserved (>95%) among circulating group M Env sequences [61], and was present in all viral sequences examined from the CH235/CH235.12 donor [30], it seems unlikely that Y458 (or another substitution at this site) contributed to the natural response that gave rise to CH235/CH235.12 in this individual. Indeed, the rarity of non-G at this position may be part of an evasion mechanism to disfavor the production of CH235/CH235.12-like bNAbs. Nonetheless, Man5-enriched CH0505TF.G458Y Env with all sequons intact may be a potent stimulator of germline CH235/CH235.12-like antibodies, and it remains possible that such variants exited in the donor at a low frequency that went undetected. Similarly, heterogeneity in Env sequon location and occupation, and in the composition of glycans at occupied sites [49, 51, 52] make it possible that other CD4bs bNAb responses in HIV-1 infected individuals are driven in part by a subpopulation of Envs that are both Man5-enriched and lack key sequons.

The Env modifications reported here suggest new avenues to pursue for immunogen design. For example, immunogens could be tailored to initiate the CH235/CH235.12 lineage by priming with Man5-enriched CH0505TF.Y458 Env protein produced in GnTI-cells and boosting with reverse engineered immunogens that contain G458 and a full complement of complex-type glycans. It will also be of interest to investigate existing VRC01 germline-targeting immunogens, such as 426c core [27, 36] and eOD-GT8 [38], that are produced in GnTI-cells. Success may depend on combining these modifications with other design features, such as closely mimicking native Env structure to assure correct angle of antibody approach [71], and circumventing immunologic tolerance [72]. Notably, it has not been possible to accurately infer the germline version of the CDRH3 region of VRC01-class bNAbs with existing sequences. Thus, while detection of neutralizing activity by the germline form of VRC01 used here is encouraging, additional Env modifications might be needed to adequately engage true VRC01-class germline B cells.

The modified Envs described here have additional value by enabling detection of early precursors of CD4bs bNAbs induced by candidate immunogens. Detection would be based on functional neutralizing activity in a high throughput assay and would complement other technologies, such as antigen-specific memory B cell sorting and immunoglobulin sequence analyses. Until the technology is refined to capture a wider range of CD4bs bNAb precursors, negative neutralizing activity would not necessarily mean that precursors are absent. Additional efforts are needed to be more inclusive of the full range of CD4bs bNAbs and to enable detection of early precursors of bNAbs to other epitopes in neutralization assays. The insights provided here should facilitate these efforts as they relate to both immune monitoring and immunogen design.

Methods

Cells

TZM-bl, 293T/17 and 293S/GnTI-cells were maintained in Dulbecco's Modified Eagle's Medium (DMEM) containing 10% fetal bovine serum (FBS) and gentamicin (50 μg/ml) in vented T-75 culture flasks (Corning-Costar). Cultures were incubated at 37° C. in a humidified 5% CO2-95% air environment. Cell monolayers were split 1:10 at confluence by treatment with 0.25% trypsin, 1 mM EDTA.

Antibodies and HIV-1 Sera

The monoclonal antibodies used in this study have been previously described: CD4bs bNAbs VRC01, VRC03, VRC04, VRC07, VRC-18b, VRC20, VRC23, 12A12 [8-10, 24], 3BNC117, 3BNC60 [7], VRC-CH31 [73], N6 [5], HJ16 [3] and IgG1b12 [74]; high mannose glycan-specific bNAb 2G12 [75]; gp41 membrane proximal external region (MPER)-specific bNAbs 2F5, 4E10 [76], 10E8 [77] and DH511.2_K3 [78]; V2-apex bNAbs PG9, PG16 [79], CH01 [73] and PGDM1400 [80]; V3-glycan bNAbs PGT121, PGT128 and 10-1074 [56, 81]; gp41-gp120 interface bNAbs PGT151 [58] and VRC34.01 [60]. VRC01, VRC34.01 and 10E8 were produced by the Vaccine Research Center, NIH. N6 was obtained from Dr. Mark Connors. 3BNC117, 3BNC60 and 10-1074 were obtained from Dr. Michel Nussenzweig. VRC-CH31 and CH01 were produced by Catalent Biologics (Madison, Wis.). DH511.2_K3 was produced by the Human Vaccine Institute, Duke University Medical Center. HJ16 was obtained from Dr. Davide Corti. IgG1b12, 2G12, 2F5, 4E10, PG9 and PG16 were purchased from Polymun Scientific (Klosterneuburg, Austria). PGDM1400, PGT121, PGT128 and PGT151 were a kind gift from Dr. Dennis Burton.

In addition to these mature bNAbs we utilized UCAs, intermediates and mature forms of CH103, CH235/CH235.12 [2, 30] and VRC-CH31 [10], which were produced by the Human Vaccine Institute, Duke University Medical Center, Durham, N.C. The unmutated common ancestor (UCA) sequence for the CH235/CH235.12 lineage used in this study differs by one amino acid from the UCA described previously [2]. The UCA used here, which we refer to as CH235 UCA2, has a methionine in the 4th position of the light chain in place of a leucine in the previously described UCA version. Other antibodies included germline-reverted forms of the VRC01-class bNAbs VRC01, VRC03, VRC04, VRC07, VRC18b, VRC20, VRC23, 12A12 and 3BNC117 [9, 10, 24, 27], which were produced at the Vaccine Research Center, NIH. These latter germline-reverted antibodies possess a mature HCDR3 region, which could not be inferred with existing sequences.

Neutralization Tier phenotyping was performed with serum pools from individuals in southern Africa (South Africa, Malawi and Tanzania) who participated in a CHAVI study of chronic HIV-1 infection (CHAVI samples 0406, 0060, 0642, 0293, 0598, 0537, 0468, 0461, 0382 and 0134).

These study subjects had all been infected for at least three years. Samples from 6-10 time points collected over 8-60 months were pooled on a per-subject basis and heat-inactivated for 30 minutes at 56° C. For deeper interrogation of neutralization phenotype, a set of monoclonal antibodies was used that show a strong preference for Tier 1 viruses. This set included V3-specific antibodies 2219, 2557, 3074, 3869, 447-52D and 838-D, and the CD4bs antibodies 654-30D, 1008-30D, 1570D, 729-30D and F105, all produced by Drs. Susan Zolla-Pazner and Miroslaw K. Gorny at New York University and the Veterans Affairs Medical Center, New York, N.Y.

Pseudotyping Envs

Full-length functional HIV-1 Envs were used for virus pseudotyping. Previous reports described Envs for strains CE1176 [82], WITO [83], TRO.11 [83], CH0505TF and CH0505.w4.3 [2]. Glycan deleted Envs CH0505TF.gly4, CH0505TF.gly197, CH0505TF.gly3.276 and CH0505TF.gly3.461 were described by Zhou et al. [62]. Envs for 426c and the glycan deleted variants 426c.SM, 426c.DM and 426c.TM were described by McGuire et al. [27]. In some cases N280D, G458Y and S365P mutations were introduced by site-directed mutagenesis as described [84].

Transfection

Env-pseudotyped viruses were produced in either 293T/17 or 293S GnTI-cells (American Type Culture Collection) as described [85]. 293S GnTI-cells lack the enzyme N-acetylglucosaminyltransferase and have been shown to yield HIV-1 Envs that contain Man6-9 glycoforms and are enriched for under-processed Man5 glycoforms in place of complex glycans [45, 54]. Env-pseudoviruses were generated by transfecting exponentially dividing 293T/17 or 293 S/GnTI-cells (5×106 cells in 12 ml growth medium in a T-75 culture flask) with 4 µg of rev/env expression plasmid and 8 µg of an env-deficient HIV-1 backbone vector (pSG3ΔEnv), using Fugene 6 transfection reagent. Cells were washed after 3-8 hours and incubated in fresh growth medium without transfection reagents. Pseudovirus-containing culture supernatants were harvested 2 days after transfection, filtered (0.45 µm), and stored at −80° C. in 1 ml aliquots. Infectivity was quantified in TZM-bl cells by performing serial fivefold dilutions of pseudovirus in quadruplicate wells in 96-well culture plates in a total volume of 100 µl of growth medium for a total of 11 dilution steps. Freshly trypsinized cells (10,000 cells in 100 µl of growth medium containing 75 µg/ml DEAE-dextran) were added to each well, and the plates were incubated at 37° C. in a humidified 5% CO2-95% air environment. After a 48-hour incubation, 100 µl of culture medium was removed from each well and 100 µl of Britelite reagent was added to the cells. After a 2-min incubation at room temperature to allow cell lysis, 150 µl of cell lysate was transferred to 96-well black solid plates (Corning-Costar) for measurements of luminescence using a Victor 3 luminometer (Perkin-Elmer Life Sciences, Shelton, Conn.). A dilution of virus that results in 50,000-250,000 relative luminescence units (RLUs) was used for neutralization assays.

Neutralization Assay

Neutralization assays were performed in TZM-bl cells (NIH AIDS Research and Reference Reagent Program) as described [85]. Briefly, a pre-titrated dose of Env-pseudotyped virus was incubated with serial 3-fold dilutions of test sample in duplicate in a total volume of 150 µl for 1 hr at 37° C. in 96-well flat-bottom culture plates. Freshly trypsinized cells (10,000 cells in 100 µl of growth medium containing 20 µg/ml DEAE dextran) were added to each well. One set of control wells received cells+virus (virus control) and another set received cells only (background control). After 48 hours of incubation, the cells were lysed by the addition of Britelite (PerkinElmer Life Sciences) and three quarters of the cell lysate was transferred to a 96-well black solid plate (Costar) for measurement of luminescence. Neutralization titers are either the serum dilution (ID50) or antibody concentration (IC50) at which relative luminescence units (RLU) were reduced by 50% compared to virus control wells after subtraction of background RLUs.

Structural Modeling and Analysis

Structural modeling of mutations in the CH235 gp120 complex (PDB: 5F9W) [2] was performed with the PyMOL Molecular Graphics System, Version 1.8 Schrödinger, LLC (http://www.pymol.org) using the mutagenesis wizard and placing mutated residues in the rotamer state corresponding to the minimum strain value. Hydrophobicity scores were assigned to amino acids using the Wimley-White whole-residue octanol scale [86]. For position 458 mutants that had neutralization curves that did not reach 50% neutralization at the highest concentration (10 mg/ml), the IC50 value was set to 25 for the regression analysis.

References for Example 11

1. McClure M O, Sattentau Q J, Beverley P C, Hearn J P, Fitzgerald A K, Zuckerman A J, et al. HIV infection of primate lymphocytes and conservation of the CD4 receptor. Nature. 1987; 330(6147):487-9. doi: 10.1038/330487a0. PubMed PMID: 2446142.
2. Bonsignori M, Zhou T, Sheng Z, Chen L, Gao F, Joyce M G, et al. Maturation Pathway from Germline to Broad HIV-1 Neutralizer of a CD4-Mimic Antibody. Cell. 2016; 165(2):449-63. doi: 10.1016/j.cell.2016.02.022. PubMed PMID: 26949186; PubMed Central PMCID: PMC4826291.
3. Corti D, Langedijk J P, Hinz A, Seaman M S, Vanzetta F, Fernandez-Rodriguez B M, et al. Analysis of memory B cell responses and isolation of novel monoclonal antibodies with neutralizing breadth from HIV-1-infected individuals. PloS one. 2010; 5(1):e8805. doi: 10.1371/journal.pone.0008805. PubMed PMID: 20098712; PubMed Central PMCID: PMC2808385.
4. Gristick H B, von Boehmer L, West A P, Jr., Schamber M, Gazumyan A, Golijanin J, et al. Natively glycosylated HIV-1 Env structure reveals new mode for antibody recognition of the CD4-binding site. Nature structural & molecular biology. 2016; 23(10):906-15. doi: 10.1038/nsmb.3291. PubMed PMID: 27617431; PubMed Central PMCID: PMC5127623.
5. Huang J, Kang B H, Ishida E, Zhou T, Griesman T, Sheng Z, et al. Identification of a CD4-Binding-Site Antibody to HIV that Evolved Near-Pan Neutralization Breadth. Immunity. 2016; 45(5):1108-21. doi: 10.1016/j.immuni.2016.10.027. PubMed PMID: 27851912.
6. Liao H X, Lynch R, Zhou T, Gao F, Alam S M, Boyd S D, et al. Co-evolution of a broadly neutralizing HIV-1 antibody and founder virus. Nature. 2013; 496(7446): 469-76. doi: 10.1038/nature12053. PubMed PMID: 23552890; PubMed Central PMCID: PMC3637846.
7. Scheid J F, Mouquet H, Ueberheide B, Diskin R, Klein F, Oliveira T Y, et al. Sequence and structural convergence of broad and potent HIV antibodies that mimic CD4 binding. Science. 2011; 333(6049):1633-7. doi: 10.1126/science.1207227. PubMed PMID: 21764753; PubMed Central PMCID: PMC3351836.

8. Wu X, Yang Z Y, Li Y, Hogerkorp C M, Schief W R, Seaman M S, et al. Rational design of envelope identifies broadly neutralizing human monoclonal antibodies to HIV-1. Science. 2010; 329(5993):856-61. doi: 10.1126/science.1187659. PubMed PMID: 20616233; PubMed Central PMCID: PMC2965066.
9. Wu X, Zhou T, Zhu J, Zhang B, Georgiev I, Wang C, et al. Focused evolution of HIV-1 neutralizing antibodies revealed by structures and deep sequencing. Science. 2011; 333(6049):1593-602. doi: 10.1126/science.1207532. PubMed PMID: 21835983; PubMed Central PMCID: PMC3516815.
10. Zhou T, Lynch R M, Chen L, Acharya P, Wu X, Doria-Rose N A, et al. Structural Repertoire of HIV-1-Neutralizing Antibodies Targeting the CD4 Supersite in 14 Donors. Cell. 2015; 161(6):1280-92. doi: 10.1016/j.cell.2015.05.007. PubMed PMID: 26004070; PubMed Central PMCID: PMC4683157.
11. Gautam R, Nishimura Y, Pegu A, Nason M C, Klein F, Gazumyan A, et al. A single injection of anti-HIV-1 antibodies protects against repeated SHIV challenges. Nature. 2016; 533(7601):105-9. doi: 10.1038/nature17677. PubMed PMID: 27120156; PubMed Central PMCID: PMC5127204.
12. Ko S Y, Pegu A, Rudicell R S, Yang Z Y, Joyce M G, Chen X, et al. Enhanced neonatal Fc receptor function improves protection against primate SHIV infection. Nature. 2014; 514(7524):642-5. doi: 10.1038/nature13612. PubMed PMID: 25119033; PubMed Central PMCID: PMC4433741.
13. Rudicell R S, Kwon Y D, Ko S Y, Pegu A, Louder M K, Georgiev I S, et al. Enhanced potency of a broadly neutralizing HIV-1 antibody in vitro improves protection against lentiviral infection in vivo. Journal of virology. 2014; 88(21):12669-82. doi: 10.1128/JVI.02213-14. PubMed PMID: 25142607; PubMed Central PMCID: PMC4248941.
14. Saunders K O, Pegu A, Georgiev I S, Zeng M, Joyce M G, Yang Z Y, et al. Sustained Delivery of a Broadly Neutralizing Antibody in Nonhuman Primates Confers Long-Term Protection against Simian/Human Immunodeficiency Virus Infection. Journal of virology. 2015; 89(11):5895-903. doi: 10.1128/JVI.00210-15. PubMed PMID: 25787288; PubMed Central PMCID: PMC4442454.
15. Saunders K O, Wang L, Joyce M G, Yang Z Y, Balazs A B, Cheng C, et al. Broadly Neutralizing Human Immunodeficiency Virus Type 1 Antibody Gene Transfer Protects Nonhuman Primates from Mucosal Simian-Human Immunodeficiency Virus Infection. Journal of virology. 2015; 89(16):8334-45. doi: 10.1128/JVI.00908-15. PubMed PMID: 26041300; PubMed Central PMCID: PMC4524228.
16. Shingai M, Donau O K, Plishka R J, Buckler-White A, Mascola J R, Nabel G J, et al. Passive transfer of modest titers of potent and broadly neutralizing anti-HIV monoclonal antibodies block SHIV infection in macaques. The Journal of experimental medicine. 2014; 211(10):2061-74. doi: 10.1084/jem.20132494. PubMed PMID: 25155019; PubMed Central PMCID: PMC4172223.
17. Caskey M, Klein F, Lorenzi J C, Seaman M S, West A P, Jr., Buckley N, et al. Viraemia suppressed in HIV-1-infected humans by broadly neutralizing antibody 3BNC117. Nature. 2015; 522(7557):487-91. doi: 10.1038/nature14411. PubMed PMID: 25855300; PubMed Central PMCID: PMC4890714.
18. Lynch R M, Boritz E, Coates E E, DeZure A, Madden P, Costner P, et al. Virologic effects of broadly neutralizing antibody VRC01 administration during chronic HIV-1 infection. Science translational medicine. 2015; 7(319): 319ra206. doi: 10.1126/scitranslmed.aad5752. PubMed PMID: 26702094.
19. Bolton D L, Pegu A, Wang K, McGinnis K, Nason M, Foulds K, et al. Human Immunodeficiency Virus Type 1 Monoclonal Antibodies Suppress Acute Simian-Human Immunodeficiency Virus Viremia and Limit Seeding of Cell-Associated Viral Reservoirs. Journal of virology. 2015; 90(3):1321-32. doi: 10.1128/JVI.02454-15. PubMed PMID: 26581981; PubMed Central PMCID: PMC4719604.
20. Shingai M, Nishimura Y, Klein F, Mouquet H, Donau O K, Plishka R, et al. Antibody-mediated immunotherapy of macaques chronically infected with SHIV suppresses viraemia. Nature. 2013; 503(7475):277-80. doi: 10.1038/nature12746. PubMed PMID: 24172896; PubMed Central PMCID: PMC4133787.
21. Mascola J R, Montefiori D C. The role of antibodies in HIV vaccines. Annual review of immunology. 2010; 28:413-44. doi: 10.1146/annurev-immunol-030409-101256. PubMed PMID: 20192810.
22. Zhou T, Georgiev I, Wu X, Yang Z Y, Dai K, Finzi A, et al. Structural basis for broad and potent neutralization of HIV-1 by antibody VRC01. Science. 2010; 329(5993): 811-7. doi: 10.1126/science.1192819. PubMed PMID: 20616231; PubMed Central PMCID: PMC2981354.
23. Zhou T, Xu L, Dey B, Hessell A J, Van Ryk D, Xiang S H, et al. Structural definition of a conserved neutralization epitope on HIV-1 gp120. Nature. 2007; 445(7129):732-7. doi: 10.1038/nature05580. PubMed PMID: 17301785; PubMed Central PMCID: PMC2584968.
24. Zhou T, Zhu J, Wu X, Moquin S, Zhang B, Acharya P, et al. Multidonor analysis reveals structural elements, genetic determinants, and maturation pathway for HIV-1 neutralization by VRC01-class antibodies. Immunity. 2013; 39(2):245-58. doi: 10.1016/j.immuni.2013.04.012. PubMed PMID: 23911655; PubMed Central PMCID: PMC3985390.
25. Hoot S, McGuire A T, Cohen K W, Strong R K, Hangartner L, Klein F, et al. Recombinant HIV envelope proteins fail to engage germline versions of anti-CD4bs bNAbs. PLoS pathogens. 2013; 9(1):e1003106. doi: 10.1371/journal.ppat.1003106. PubMed PMID: 23300456; PubMed Central PMCID: PMC3536657.
26. Jardine J, Julien J P, Menis S, Ota T, Kalyuzhniy O, McGuire A, et al. Rational HIV immunogen design to target specific germline B cell receptors. Science. 2013; 340(6133):711-6. doi: 10.1126/science.1234150. PubMed PMID: 23539181; PubMed Central PMCID: PMC3689846.
27. McGuire A T, Hoot S, Dreyer A M, Lippy A, Stuart A, Cohen K W, et al. Engineering HIV envelope protein to activate germline B cell receptors of broadly neutralizing anti-CD4 binding site antibodies. The Journal of experimental medicine. 2013; 210(4):655-63. doi: 10.1084/jem.20122824. PubMed PMID: 23530120; PubMed Central PMCID: PMC3620356.
28. Mouquet H, Scheid J F, Zoller M J, Krogsgaard M, Ott R G, Shukair S, et al. Polyreactivity increases the apparent affinity of anti-HIV antibodies by heteroligation. Nature. 2010; 467(7315):591-5. doi: 10.1038/nature09385. PubMed PMID: 20882016; PubMed Central PMCID: PMC3699875.

29. Xiao X, Chen W, Feng Y, Zhu Z, Prabakaran P, Wang Y, et al. Germline-like predecessors of broadly neutralizing antibodies lack measurable binding to HIV-1 envelope glycoproteins: implications for evasion of immune responses and design of vaccine immunogens. Biochemical and biophysical research communications. 2009; 390(3):404-9. doi: 10.1016/j.bbrc.2009.09.029. PubMed PMID: 19748484; PubMed Central PMCID: PMC2787893.

30. Gao F, Bonsignori M, Liao H X, Kumar A, Xia S M, Lu X, et al. Cooperation of B cell lineages in induction of HIV-1-broadly neutralizing antibodies. Cell. 2014; 158(3):481-91. doi: 10.1016/j.cell.2014.06.022. PubMed PMID: 25065977; PubMed Central PMCID: PMC4150607.

31. Wu X, Zhang Z, Schramm C A, Joyce M G, Kwon Y D, Zhou T, et al. Maturation and Diversity of the VRC01-Antibody Lineage over 15 Years of Chronic HIV-1 Infection. Cell. 2015; 161(3):470-85. doi: 10.1016/j.cell.2015.03.004. PubMed PMID: 25865483; PubMed Central PMCID: PMC4706178.

32. Scharf L, West A P, Sievers S A, Chen C, Jiang S, Gao H, et al. Structural basis for germline antibody recognition of HIV-1 immunogens. eLife. 2016; 5. doi: 10.7554/eLife.13783. PubMed PMID: 26997349; PubMed Central PMCID: PMC4811768.

33. Yacoob C, Pancera M, Vigdorovich V, Oliver B G, Glenn J A, Feng J, et al. Differences in Allelic Frequency and CDRH3 Region Limit the Engagement of HIV Env Immunogens by Putative VRC01 Neutralizing Antibody Precursors. Cell reports. 2016; 17(6):1560-70. doi: 10.1016/j.celrep.2016.10.017. PubMed PMID: 27806295; PubMed Central PMCID: PMC5207042.

34. Diskin R, Scheid J F, Marcovecchio P M, West A P, Jr., Klein F, Gao H, et al. Increasing the potency and breadth of an HIV antibody by using structure-based rational design. Science. 2011; 334(6060):1289-93. doi: 10.1126/science.1213782. PubMed PMID: 22033520; PubMed Central PMCID: PMC3232316.

35. Li Y, O'Dell S, Walker L M, Wu X, Guenaga J, Feng Y, et al. Mechanism of neutralization by the broadly neutralizing HIV-1 monoclonal antibody VRC01. Journal of virology. 2011; 85(17):8954-67. doi: 10.1128/JVI.00754-11. PubMed PMID: 21715490; PubMed Central PMCID: PMC3165784.

36. McGuire A T, Gray M D, Dosenovic P, Gitlin A D, Freund N T, Petersen J, et al. Specifically modified Env immunogens activate B-cell precursors of broadly neutralizing HIV-1 antibodies in transgenic mice. Nature communications. 2016; 7:10618. doi: 10.1038/ncomms10618. PubMed PMID: 26907590; PubMed Central PMCID: PMC4770077.

37. Jardine J G, Kulp D W, Havenar-Daughton C, Sarkar A, Briney B, Sok D, et al. HIV-1 broadly neutralizing antibody precursor B cells revealed by germline-targeting immunogen. Science. 2016; 351(6280):1458-63. doi: 10.1126/science.aad9195. PubMed PMID: 27013733; PubMed Central PMCID: PMC4872700.

38. Jardine J G, Ota T, Sok D, Pauthner M, Kulp D W, Kalyuzhniy O, et al. HIV-1 VACCINES. Priming a broadly neutralizing antibody response to HIV-1 using a germline-targeting immunogen. Science. 2015; 349(6244):156-61. doi: 10.1126/science.aac5894. PubMed PMID: 26089355; PubMed Central PMCID: PMC4669217.

39. Leonard C K, Spellman M W, Riddle L, Harris R J, Thomas J N, Gregory T J. Assignment of intrachain disulfide bonds and characterization of potential glycosylation sites of the type 1 recombinant human immunodeficiency virus envelope glycoprotein (gp120) expressed in Chinese hamster ovary cells. The Journal of biological chemistry. 1990; 265(18):10373-82. PubMed PMID: 2355006.

40. Doores K J, Bonomelli C, Harvey D J, Vasiljevic S, Dwek R A, Burton D R, et al. Envelope glycans of immunodeficiency virions are almost entirely oligomannose antigens. Proceedings of the National Academy of Sciences of the United States of America. 2010; 107(31): 13800-5. doi: 10.1073/pnas.1006498107. PubMed PMID: 20643940; PubMed Central PMCID: PMC2922250.

41. Go E P, Liao H X, Alam S M, Hua D, Haynes B F, Desaire H. Characterization of host-cell line specific glycosylation profiles of early transmitted/founder HIV-1 gp120 envelope proteins. Journal of proteome research. 2013; 12(3):1223-34. doi: 10.1021/pr300870t. PubMed PMID: 23339644; PubMed Central PMCID: PMC3674872.

42. Pritchard L K, Spencer D I, Royle L, Bonomelli C, Seabright G E, Behrens A J, et al. Glycan clustering stabilizes the mannose patch of HIV-1 and preserves vulnerability to broadly neutralizing antibodies. Nature communications. 2015; 6:7479. doi: 10.1038/ncomms8479. PubMed PMID: 26105115; PubMed Central PMCID: PMC4500839.

43. Pritchard L K, Vasiljevic S, Ozorowski G, Seabright G E, Cupo A, Ringe R, et al. Structural Constraints Determine the Glycosylation of HIV-1 Envelope Trimers. Cell reports. 2015; 11(10):1604-13. doi: 10.1016/j.celrep.2015.05.017. PubMed PMID: 26051934; PubMed Central PMCID: PMC4555872.

44. Bonomelli C, Doores K J, Dunlop D C, Thaney V, Dwek R A, Burton D R, et al. The glycan shield of HIV is predominantly oligomannose independently of production system or viral clade. PloS one. 2011; 6(8):e23521. doi: 10.1371/journal.pone.0023521. PubMed PMID: 21858152; PubMed Central PMCID: PMC3156772.

45. Eggink D, Melchers M, Wuhrer M, van Montfort T, Dey A K, Naaijkens B A, et al. Lack of complex N-glycans on HIV-1 envelope glycoproteins preserves protein conformation and entry function. Virology. 2010; 401(2):236-47. doi: 10.1016/j.virol.2010.02.019. PubMed PMID: 20304457; PubMed Central PMCID: PMC3776475.

46. Geyer H, Holschbach C, Hunsmann G, Schneider J. Carbohydrates of human immunodeficiency virus. Structures of oligosaccharides linked to the envelope glycoprotein 120. The Journal of biological chemistry. 1988; 263(24):11760-7. PubMed PMID: 2841333.

47. Go E P, Herschhorn A, Gu C, Castillo-Menendez L, Zhang S, Mao Y, et al. Comparative Analysis of the Glycosylation Profiles of Membrane-Anchored HIV-1 Envelope Glycoprotein Trimers and Soluble gp140. Journal of virology. 2015; 89(16):8245-57. doi: 10.1128/JVI.00628-15. PubMed PMID: 26018173; PubMed Central PMCID: PMC4524223.

48. Go E P, Hewawasam G, Liao H X, Chen H, Ping L H, Anderson J A, et al. Characterization of glycosylation profiles of HIV-1 transmitted/founder envelopes by mass spectrometry. Journal of virology. 2011; 85(16):8270-84. doi: 10.1128/JVI.05053-11. PubMed PMID: 21653661; PubMed Central PMCID: PMC3147976.

49. Go E P, Irungu J, Zhang Y, Dalpathado D S, Liao H X, Sutherland L L, et al. Glycosylation site-specific analysis of HIV envelope proteins (JR-FL and CON-S) reveals major differences in glycosylation site occupancy, glycoform profiles, and antigenic epitopes' accessibility. Journal of proteome research. 2008; 7(4):1660-74. doi: 10.1021/pr7006957. PubMed PMID: 18330979; PubMed Central PMCID: PMC3658474.
50. Pritchard L K, Harvey D J, Bonomelli C, Crispin M, Doores K J. Cell- and Protein-Directed Glycosylation of Native Cleaved HIV-1 Envelope. Journal of virology. 2015; 89(17):8932-44. doi: 10.1128/JVI.01190-15. PubMed PMID: 26085151; PubMed Central PMCID: PMC4524065.
51. Pritchard L K, Spencer D I, Royle L, Vasiljevic S, Krumm S A, Doores K J, et al. Glycan Microheterogeneity at the PGT135 Antibody Recognition Site on HIV-1 gp120 Reveals a Molecular Mechanism for Neutralization Resistance. Journal of virology. 2015; 89(13):6952-9. doi: 10.1128/JVI.00230-15. PubMed PMID: 25878100; PubMed Central PMCID: PMC4468474.
52. Behrens A J, Vasiljevic S, Pritchard L K, Harvey D J, Andev R S, Krumm S A, et al. Composition and Antigenic Effects of Individual Glycan Sites of a Trimeric HIV-1 Envelope Glycoprotein. Cell reports. 2016; 14(11):2695-706. doi: 10.1016/j.celrep.2016.02.058. PubMed PMID: 26972002; PubMed Central PMCID: PMC4805854.
53. Cao L, Diedrich J K, Kulp D W, Pauthner M, He L, Park S R, et al. Global site-specific N-glycosylation analysis of HIV envelope glycoprotein. Nature communications. 2017; 8:14954. doi: 10.1038/ncomms14954. PubMed PMID: 28348411; PubMed Central PMCID: PMC5379070.
54. Binley J M, Ban Y E, Crooks E T, Eggink D, Osawa K, Schief W R, et al. Role of complex carbohydrates in human immunodeficiency virus type 1 infection and resistance to antibody neutralization. Journal of virology. 2010; 84(11):5637-55. doi: 10.1128/JVI.00105-10. PubMed PMID: 20335257; PubMed Central PMCID: PMC2876609.
55. Reeves P J, Callewaert N, Contreras R, Khorana H G. Structure and function in rhodopsin: high-level expression of rhodopsin with restricted and homogeneous N-glycosylation by a tetracycline-inducible N-acetylglucosaminyltransferase I-negative HEK293S stable mammalian cell line. Proceedings of the National Academy of Sciences of the United States of America. 2002; 99(21): 13419-24. doi: 10.1073/pnas.212519299. PubMed PMID: 12370423; PubMed Central PMCID: PMC129688.
56. Mouquet H, Scharf L, Euler Z, Liu Y, Eden C, Scheid J F, et al. Complex-type N-glycan recognition by potent broadly neutralizing HIV antibodies. Proceedings of the National Academy of Sciences of the United States of America. 2012; 109(47):E3268-77. doi: 10.1073/pnas.1217207109. PubMed PMID: 23115339; PubMed Central PMCID: PMC3511153.
57. Balla-Jhagjhoorsingh S S, Corti D, Heyndrickx L, Willems E, Vereecken K, Davis D, et al. The N276 glycosylation site is required for HIV-1 neutralization by the CD4 binding site specific HJ16 monoclonal antibody. PloS one. 2013; 8(7):e68863. doi: 10.1371/journal.pone.0068863. PubMed PMID: 23874792; PubMed Central PMCID: PMC3 714269.
58. Falkowska E, Le K M, Ramos A, Doores K J, Lee J H, Blattner C, et al. Broadly neutralizing HIV antibodies define a glycan-dependent epitope on the prefusion conformation of gp41 on cleaved envelope trimers. Immunity. 2014; 40(5):657-68. doi: 10.1016/j.immuni.2014.04.009. PubMed PMID: 24768347; PubMed Central PMCID: PMC4070425.
59. Blattner C, Lee J H, Sliepen K, Derking R, Falkowska E, de la Pena A T, et al. Structural delineation of a quaternary, cleavage-dependent epitope at the gp41-gp120 interface on intact HIV-1 Env trimers. Immunity. 2014; 40(5):669-80. doi: 10.1016/j.immuni.2014.04.008. PubMed PMID: 24768348; PubMed Central PMCID: PMC4057017.
60. Kong R, Xu K, Zhou T, Acharya P, Lemmin T, Liu K, et al. Fusion peptide of HIV-1 as a site of vulnerability to neutralizing antibody. Science. 2016; 352(6287):828-33. doi: 10.1126/science.aae0474. PubMed PMID: 27174988; PubMed Central PMCID: PMC4917739.
61. Lynch R M, Wong P, Tran L, O'Dell S, Nason M C, Li Y, et al. HIV-1 fitness cost associated with escape from the VRC01 class of CD4 binding site neutralizing antibodies. Journal of virology. 2015; 89(8):4201-13. doi: 10.1128/JVI.03608-14. PubMed PMID: 25631091; PubMed Central PMCID: PMC4442379.
62. Zhou T, Doria-Rose N A, Cheng C, Stewart-Jones G B E, Chuang G Y, Chambers M, et al. Quantification of the Impact of the HIV-1-Glycan Shield on Antibody Elicitation. Cell reports. 2017; 19(4):719-32. doi: 10.1016/j.celrep.2017.04.013. PubMed PMID: 28445724.
63. Diskin R, Klein F, Horwitz J A, Halper-Stromberg A, Sather D N, Marcovecchio P M, et al. Restricting HIV-1 pathways for escape using rationally designed anti-HIV-1 antibodies. The Journal of experimental medicine. 2013; 210(6):1235-49. doi: 10.1084/jem.20130221. PubMed PMID: 23712429; PubMed Central PMCID: PMC3674693.
64. Horwitz J A, Halper-Stromberg A, Mouquet H, Gitlin A D, Tretiakova A, Eisenreich T R, et al. HIV-1 suppression and durable control by combining single broadly neutralizing antibodies and antiretroviral drugs in humanized mice. Proceedings of the National Academy of Sciences of the United States of America. 2013; 110(41):16538-43. doi: 10.1073/pnas.1315295110. PubMed PMID: 24043801; PubMed Central PMCID: PMC3799352.
65. Klein F, Halper-Stromberg A, Horwitz J A, Gruell H, Scheid J F, Bournazos S, et al. HIV therapy by a combination of broadly neutralizing antibodies in humanized mice. Nature. 2012; 492(7427):118-22. doi: 10.1038/nature11604. PubMed PMID: 23103874; PubMed Central PMCID: PMC3809838.
66. Klein F, Nogueira L, Nishimura Y, Phad G, West A P, Jr., Halper-Stromberg A, et al. Enhanced HIV-1 immunotherapy by commonly arising antibodies that target virus escape variants. The Journal of experimental medicine. 2014; 211(12):2361-72. doi: 10.1084/jem.20141050. PubMed PMID: 25385756; PubMed Central PMCID: PMC4235636.
67. West A P, Jr., Diskin R, Nussenzweig M C, Bjorkman P J. Structural basis for germ-line gene usage of a potent class of antibodies targeting the CD4-binding site of HIV-1 gp120. Proceedings of the National Academy of Sciences of the United States of America. 2012; 109(30):

E2083-90. doi: 10.1073/pnas.1208984109. PubMed PMID: 22745174; PubMed Central PMCID: PMC3409792.

68. Harris A, Borgnia M J, Shi D, Bartesaghi A, He H, Pejchal R, et al. Trimeric HIV-1 glycoprotein gp140 immunogens and native HIV-1 envelope glycoproteins display the same closed and open quaternary molecular architectures. Proceedings of the National Academy of Sciences of the United States of America. 2011; 108(28): 11440-5. doi: 10.1073/pnas.1101414108. PubMed PMID: 21709254; PubMed Central PMCID: PMC3136299.

69. Sanders R W, Derking R, Cupo A, Julien J P, Yasmeen A, de Val N, et al. A next-generation cleaved, soluble HIV-1 Env trimer, BG505 SOSIP.664 gp140, expresses multiple epitopes for broadly neutralizing but not non-neutralizing antibodies. PLoS pathogens. 2013; 9(9): e1003618. doi: 10.1371/journal.ppat.1003618. PubMed PMID: 24068931; PubMed Central PMCID: PMC3777863.

70. Seaman M S, Janes H, Hawkins N, Grandpre L E, Devoy C, Giri A, et al. Tiered categorization of a diverse panel of HIV-1 Env pseudoviruses for assessment of neutralizing antibodies. Journal of virology. 2010; 84(3):1439-52. doi: 10.1128/JVI.02108-09. PubMed PMID: 19939925; PubMed Central PMCID: PMC2812321.

71. de Taeye S W, Moore J P, Sanders R W. HIV-1 Envelope Trimer Design and Immunization Strategies To Induce Broadly Neutralizing Antibodies. Trends Immunol. 2016; 37(3):221-32. Epub 2016/02/13. doi: 10.1016/j.it.2016.01.007. PubMed PMID: 26869204; PubMed Central PMCID: PMCPMC5454186.

72. Mascola J R, Haynes B F. HIV-1 neutralizing antibodies: understanding nature's pathways. Immunol Rev. 2013; 254(1):225-44. Epub 2013/06/19. doi: 10.1111/imr.12075. PubMed PMID: 23772623; PubMed Central PMCID: PMCPMC3738265.

73. Bonsignori M, Montefiori D C, Wu X, Chen X, Hwang K K, Tsao C Y, et al. Two distinct broadly neutralizing antibody specificities of different clonal lineages in a single HIV-1-infected donor: implications for vaccine design. Journal of virology. 2012; 86(8):4688-92. doi: 10.1128/JVI.07163-11. PubMed PMID: 22301150; PubMed Central PMCID: PMC3318651.

74. Burton D R, Pyati J, Koduri R, Sharp S J, Thornton G B, Parren P W, et al. Efficient neutralization of primary isolates of HIV-1 by a recombinant human monoclonal antibody. Science. 1994; 266(5187):1024-7. PubMed PMID: 7973652.

75. Calarese D A, Scanlan C N, Zwick M B, Deechongkit S, Mimura Y, Kunert R, et al. Antibody domain exchange is an immunological solution to carbohydrate cluster recognition. Science. 2003; 300(5628):2065-71. doi: 10.1126/science.1083182. PubMed PMID: 12829775.

76. Zwick M B, Labrijn A F, Wang M, Spenlehauer C, Saphire E O, Binley J M, et al. Broadly neutralizing antibodies targeted to the membrane-proximal external region of human immunodeficiency virus type 1 glycoprotein gp41. Journal of virology. 2001; 75(22):10892-905. doi: 10.1128/JVI.75.22.10892-10905.2001. PubMed PMID: 11602729; PubMed Central PMCID: PMC114669.

77. Huang J, Ofek G, Laub L, Louder M K, Doria-Rose N A, Longo N S, et al. Broad and potent neutralization of HIV-1 by a gp41-specific human antibody. Nature. 2012; 491(7424):406-12. doi: 10.1038/nature1 1544. PubMed PMID: 23151583; PubMed Central PMCID: PMC4854285.

78. Williams L D, Ofek, G., Schatzle, S., McDaniel, J. R., Lu, X., Nicely, N. I., Wu, L., Lougheed, C. S., Bradley, R., Louder, M. K., McKee, K., Bailer, R. T., O'Dell, S., Georgiev, I. S., Seaman, M S., Parks, R. J., Marshall, D. J., Anasti, K., Yang, G., Nie, X., Tumba, N. L., Wiehe, K., Wagh, K., Korber, B., Kepler, T. B., Alam, M. S., Morris, L., Kamanga, G., Cohen, M S., Bonsignori, M., Xia, S.-M., Montefiori, D. C., Kelsoe, G., Gao, F., Mascola, J. R., Moody, M. A., Saunders, K. O., Liao, H.-X.,Tomaras, G. D., Georgiou, G., Haynes, B. F. Potent and broad HIV-neutralizing antibodies in memory B cells and plasma. Science Immunology 2017; 2(7):eaal2200. doi: 10.1126/sciimmunol.aal2200.

79. Walker L M, Phogat S K, Chan-Hui P Y, Wagner D, Phung P, Goss J L, et al. Broad and potent neutralizing antibodies from an African donor reveal a new HIV-1 vaccine target. Science. 2009; 326(5950):285-9. doi: 10.1126/science.1178746. PubMed PMID: 19729618; PubMed Central PMCID: PMC3335270.

80. Sok D, van Gils M J, Pauthner M, Julien J P, Saye-Francisco K L, Hsueh J, et al. Recombinant HIV envelope trimer selects for quaternary-dependent antibodies targeting the trimer apex. Proceedings of the National Academy of Sciences of the United States of America. 2014; 111(49):17624-9. doi: 10.1073/pnas.1415789111. PubMed PMID: 25422458; PubMed Central PMCID: PMC4267403.

81. Walker L M, Huber M, Doores K J, Falkowska E, Pejchal R, Julien J P, et al. Broad neutralization coverage of HIV by multiple highly potent antibodies. Nature. 2011; 477(7365):466-70. doi: 10.1038/nature10373. PubMed PMID: 21849977; PubMed Central PMCID: PMC3393110.

82. deCamp A, Hraber P, Bailer R T, Seaman M S, Ochsenbauer C, Kappes J, et al. Global panel of HIV-1 Env reference strains for standardized assessments of vaccine-elicited neutralizing antibodies. Journal of virology. 2014; 88(5):2489-507. doi: 10.1128/JVI.02853-13. PubMed PMID: 24352443; PubMed Central PMCID: PMC3958090.

83. Li M, Gao F, Mascola J R, Stamatatos L, Polonis V R, Koutsoukos M, et al. Human immunodeficiency virus type 1 env clones from acute and early subtype B infections for standardized assessments of vaccine-elicited neutralizing antibodies. Journal of virology. 2005; 79(16): 10108-25. doi: 10.1128/JVI.79.16.10108-10125.2005. PubMed PMID: 16051804; PubMed Central PMCID: PMC1182643.

84. Tang H, Robinson J E, Gnanakaran S, Li M, Rosenberg E S, Perez L G, et al. epitopes immediately below the base of the V3 loop of gp120 as targets for the initial autologous neutralizing antibody response in two HIV-1 subtype B-infected individuals. Journal of virology. 2011; 85(18): 9286-99. doi: 10.1128/JVI.02286-10. PubMed PMID: 21734041; PubMed Central PMCID: PMC3165744.

85. Montefiori D C. Measuring HIV neutralization in a luciferase reporter gene assay. Methods in molecular biology. 2009; 485:395-405. doi: 10.1007/978-1-59745-170-3_26. PubMed PMID: 19020839.

86. Wimley W C, Creamer T P, White S H. Solvation energies of amino acid side chains and backbone in a family of host-guest pentapeptides. Biochemistry. 1996; 35(16):5109-24. Epub 1996/04/23. doi: 10.1021/bi9600153. PubMed PMID: 8611495.

Example 11

TABLE 23

Epitope mapping identifies a G458Y mutation in the context of GnTI-CH0505TF Env as a potential germline-targeting feature for the CH235 lineage.

| | Envs Produced in 293T Cells:[1] IC50 (μg/ml) in TZM-bl | | | |
|---|---|---|---|---|
| ANTIBODY | CH0505TF | CH0505TF.N280D | CH0505TF.G458Y | CH0505TF.S365P |
| CH103 | 1.9 | 1.2 | 5.8 | >50 |
| CH235 | 0.3 | >25 | 0.1 | 0.6 |
| CH235.12 | 0.04 | 0.06 | 0.01 | 0.03 |
| VRC01 | 0.1 | >25 | >25 | 0.1 |
| 3BNC117 | 0.03 | >25 | >25 | 0.01 |
| N6 | 0.06 | >17 | 0.02 | 0.02 |
| VRC-CH31 | 0.03 | >25 | <0.01 | 1.2 |

| | Envs Produced in 293S GnTI Cells:[2] IC50 (μg/ml) in TZM-bl | | | |
|---|---|---|---|---|
| ANTIBODY | CH0505TF | CH0505TF.N280D | CH0505TF.G458Y | CH0505TF.S365P |
| CH103_UCA1.1_4A | >50 | >50 | >50 | >50 |
| CH103_UCAGrand5 | >50 | >50 | >50 | >50 |
| CH103_IA_9_4A | >50 | >50 | >50 | >50 |
| CH103_IA_8_4A | 0.55 | 0.85 | 2.0 | >50 |
| CH103_IA_7_4A | 0.13 | 0.4 | 0.9 | >50 |
| CH103_IA_6_4A | 0.64 | 2.8 | 8.7 | >50 |
| CH103_IA_5_4A | 0.46 | 0.18 | 12.7 | >30 |
| CH103_IA_4_4A | 0.19 | 0.22 | 1.0 | >50 |
| CH103 | 0.57 | 0.24 | 0.44 | 1.7 |
| CH235 UCA2 | >25 | >25 | 0.16 | >25 |
| CH235_I4_v2_4A/293i | 1.4 | >50 | 0.08 | 26 |
| CH235_I3_v2_4A | 0.12 | >50 | 0.03 | 0.16 |
| CH235VH_I1_v2_4A/293i | 0.05 | >50 | <0.02 | 0.04 |
| CH235 | 0.03 | 3.4 | <0.02 | 0.02 |
| CH235.12 | 0.02 | 0.02 | <0.02 | 0.01 |

[1]Highlight values in the top section of the table are the most dramatic cases of resistance-mediating effects.
[2]Highlighted values in the bottom section of the table are the remarkable neutralization potencies seen with UCAs and intermediates of CH235.

Example 11

TABLE 24

Neutralization properties of parental and targeted glycan deleted variants of Env 426c produced in either 293T or 293S GnTI⁻ cells.

| | Tier Phenotyping: | | | | |
|---|---|---|---|---|---|
| | | ID50 (dilution) in TZM-bl | | | |
| | | 293T VIRUSES | | | |
| Reagent | Epitope | 426c | 426c.SM | 426c.DM | 426c.TM | 426c.TM4 |
| HIV-1 sera: | | | | | | |
| CHAVI-0406 | Polyclonal | 20 | 20 | 20 | 86 | 58 |
| CHAVI-0060 | Polyclonal | 40 | 31 | 31 | 52 | 49 |
| CHAVI-0642 | Polyclonal | 55 | 68 | 51 | 129 | 67 |
| CHAVI-0293 | Polyclonal | 20 | 20 | 20 | 113 | 87 |
| CHAVI-0598 | Polyclonal | 199 | 264 | 225 | 451 | 229 |
| Geometric mean titer | | 45 | 47 | 43 | 124 | 82 |

TABLE 24-continued

Neutralization properties of parental and targeted glycan deleted variants of Env 426c produced in either 293T or 293S GnTI⁻ cells.

| | | 293S GnTI– VIRUSES | | | | |
|---|---|---|---|---|---|---|
| Reagent | Epitope | 426c | 426c.SM | 426c.DM | 426c.TM | 426c.TM4 |
| HIV-1 sera: | | | | | | |
| CHAVI-0406 | Polyclonal | 172 | 201 | 230 | 338 | 351 |
| CHAVI-0060 | Polyclonal | 100 | 144 | 95 | 338 | 135 |
| CHAVI-0642 | Polyclonal | 282 | 339 | 169 | 519 | 309 |
| CHAVI-0293 | Polyclonal | 26 | 46 | 42 | 543 | 261 |
| CHAVI-0598 | Polyclonal | 963 | 1544 | 1152 | 3011 | 1124 |
| Geometric mean titer | | 165 | 234 | 178 | 627 | 336 |

Monoclonal Antibodies:

| | | IC50 (µg/ml) in TZM-bl 293T VIRUSES | | | | |
|---|---|---|---|---|---|---|
| Reagent | Epitope | 426c | 426c.SM | 426c.DM | 426c.TM | 426c.TM4 |
| Non-neutralizing Abs: | | | | | | |
| 2219 | V3 | >25 | >25 | >25 | >25 | >25 |
| 2557 | V3 | >25 | >25 | >25 | >25 | >25 |
| 3074 | V3 | >25 | >25 | >25 | >25 | >25 |
| 3869 | V3 | >25 | >25 | >25 | >25 | >25 |
| 447-52D | V3 | >25 | >25 | >25 | >25 | >25 |
| 838-12D | V3 | >25 | >25 | >25 | >25 | >25 |
| 654-30D | CD4bs | >25 | >25 | >25 | >25 | >25 |
| 1008-30D | CD4bs | >25 | >25 | >25 | >25 | >25 |
| 1570D | CD4bs | >25 | >25 | >25 | >25 | >25 |
| 729-30D | CD4bs | >25 | >25 | >25 | >25 | >25 |
| F105 | CD4bs | >25 | >25 | >25 | >25 | >25 |
| Mature bNAbs: | | | | | | |
| 2G12 | glycan | >25 | >25 | >25 | >25 | >25 |
| 2F5 | MPER | >25 | >25 | >25 | >25 | >25 |
| 4E10 | MPER | 3.32 | 1.52 | 1.00 | 0.98 | 1.66 |
| 10E8 | MPER | 0.8 | 1.26 | 1.11 | 1.52 | 0.53 |
| DH511.2_K3 | MPER | 0.8 | 0.77 | 1.50 | 1.06 | 0.56 |
| CH01 | V2-gly | >25 | >25 | >25 | >25 | >25 |
| PG9 | V2-gly | >5 | >5 | >5 | >5 | >5 |
| PG16 | V2-gly | >5 | >5 | >5 | >5 | >5 |
| PGDM1400 | V2-gly | >25 | >25 | >25 | >25 | >5 |
| PGT121 | V3-gly | >5 | >5 | >5 | >5 | >5 |
| PGT128 | V3-gly | >5 | >5 | >5 | >5 | >5 |
| 10-1074 | V3-gly | 0.05 | 0.12 | 0.10 | 0.16 | 0.06 |
| PGT151 | gp120/gp41 | 0.01 | 0.01 | 0.01 | 0.01 | 0.01 |
| VRC34.01 | gp120/gp41 | 0.08 | 0.06 | 0.09 | 0.08 | 0.13 |
| b12 | CD4bs | >25 | >25 | >25 | >25 | >25 |
| HJ16 | CD4bs | >25 | >25 | >25 | >25 | >25 |
| 3BNC117 | CD4bs | 0.20 | 0.24 | 0.13 | 0.01 | 0.003 |
| VRC-CH31 | CD4bs | 0.62 | >25 | 0.73 | >25 | 0.15 |
| CH103 | CD4bs | >40 | >40 | 6.1 | 5.2 | 3.7 |
| CH235 | CD4bs | >50 | >50 | >50 | >50 | >25 |
| CH235.12 | CD4bs | 8.95 | 1.08 | 0.66 | 0.09 | 0.1 |
| VRC01 | CD4bs | 2.20 | 0.39 | 0.41 | 0.03 | 0.002 |
| VRC03 | CD4bs | nt | nt | nt | nt | 0.003 |
| VRC04 | CD4bs | nt | nt | nt | nt | 0.013 |
| VRC07 | CD4bs | nt | nt | nt | nt | <0.002 |
| VRC018 | CD4bs | nt | nt | nt | nt | 0.005 |
| VRC20 (VRC-PG20) | CD4bs | nt | nt | nt | nt | <0.002 |
| VRC23 | CD4bs | nt | nt | nt | nt | 0.082 |
| 12A12 | CD4bs | nt | nt | nt | nt | 0.003 |

TABLE 24-continued

Neutralization properties of parental and targeted glycan deleted variants of Env 426c produced in either 293T or 293S GnTI⁻ cells.

| UCA and intermediate Abs: | | | | | | |
|---|---|---|---|---|---|---|
| VRC01gHvgLv | CD4bs | >50 | >50 | >50 | >50 | >25 |
| VRC03gHvgLv | CD4bs | nt | nt | nt | nt | >25 |
| VRC04gHvgLv | CD4bs | nt | nt | nt | nt | >25 |
| VRC07gHvgLv | CD4bs | nt | nt | nt | nt | >25 |
| VRC18gHvgLv | CD4bs | nt | nt | nt | nt | >25 |
| VRC20 (VRC-PG20)gHvgLv | CD4bs | nt | nt | nt | nt | 2.39 |
| VRC23gHvgLv | CD4bs | nt | nt | nt | nt | >25 |
| 12A12gl | CD4bs | nt | nt | nt | nt | >25 |
| 3BNC117gl | CD4bs | nt | nt | nt | nt | >25 |
| CH103_UCA1.1_4A | CD4bs | >50 | nt | nt | >50 | >25 |
| CH103_UCAGrand5 | CD4bs | >50 | nt | nt | >50 | >25 |
| CH103_IA_9_4A | CD4bs | >50 | nt | nt | >50 | >25 |
| CH103_IA_8_4A | CD4bs | >50 | nt | nt | >50 | >25 |
| CH103_IA_7_4A | CD4bs | >50 | nt | nt | >50 | >25 |
| CH103_IA_6_4A | CD4bs | >50 | nt | nt | >50 | >25 |
| CH103_IA_5_4A | CD4bs | >20 | nt | nt | >20 | >25 |
| CH103_IA_4_4A | CD4bs | >50 | nt | nt | >50 | >25 |
| CH235 UCA2 | CD4bs | >50 | nt | nt | >50 | >25 |
| CH235_I4_v2_4A | CD4bs | >50 | nt | nt | >50 | >25 |
| CH235_I3_v2_4A | CD4bs | >50 | nt | nt | >50 | >25 |
| CH235VH_I1_v2_4A | CD4bs | >50 | nt | nt | >50 | >25 |
| VRC-CH31 AbCH3X_UCA | CD4bs | >50 | nt | >50 | nt | >25 |
| VRC-CH31 AbCH3X_I4 | CD4bs | 1.3 | nt | 0.6 | nt | 0.02 |
| VRC-CH31 AbCH3X_I3 | CD4bs | 1.4 | nt | 0.8 | nt | 0.01 |
| VRC-CH31 AbCH3X_I2 | CD4bs | 1.5 | nt | 0.9 | nt | 0.07 |
| VRC-CH31 AbCH3X_I1 | CD4bs | 1.9 | nt | 1.15 | nt | 0.15 |

| | | 293S GnTI– VIRUSES | | | | |
|---|---|---|---|---|---|---|
| Reagent | Epitope | 426c | 426c.SM | 426c.DM | 426c.TM | 426c.TM4 |
| Non-neutralizing Abs: | | | | | | |
| 2219 | V3 | >25 | >25 | >25 | >25 | >25 |
| 2557 | V3 | >25 | >25 | >25 | >25 | >25 |
| 3074 | V3 | >25 | 23 | >25 | >25 | >25 |
| 3869 | V3 | >25 | >25 | >25 | >25 | >25 |
| 447-52D | V3 | >25 | >25 | >25 | >25 | >25 |
| 838-12D | V3 | >25 | >25 | >25 | >25 | >25 |
| 654-30D | CD4bs | >25 | >25 | >25 | >25 | >25 |
| 1008-30D | CD4bs | >25 | >25 | >25 | >25 | >25 |
| 1570D | CD4bs | >25 | >25 | >25 | >25 | >25 |
| 729-30D | CD4bs | >25 | >25 | >25 | >25 | >25 |
| F105 | CD4bs | >25 | >25 | >25 | >25 | >25 |
| Mature bNAbs: | | | | | | |
| 2G12 | glycan | >25 | >25 | >25 | >25 | >25 |
| 2F5 | MPER | >25 | >25 | >25 | >25 | >25 |
| 4E10 | MPER | 4 | 3.8 | 3.7 | 4 | 1.6 |
| 10E8 | MPER | 0.35 | 0.28 | 0.45 | 0.51 | 0.19 |
| DH511.2_K3 | MPER | 0.85 | 0.87 | 0.75 | 1.2 | 0.56 |
| CH01 | V2-gly | >25 | >25 | >25 | >25 | >25 |
| PG9 | V2-gly | >5 | >5 | >5 | >5 | >5 |
| PG16 | V2-gly | >5 | >5 | >5 | >5 | >5 |
| PGDM1400 | V2-gly | >5 | >5 | >5 | >5 | >5 |
| PGT121 | V3-gly | 2.5 | 4.2 | 3.4 | 3.4 | >5 |
| PGT128 | V3-gly | 4.3 | >5 | >5 | >5 | >5 |
| 10-1074 | V3-gly | 0.03 | 0.04 | 0.03 | 0.03 | 0.02 |
| PGT151 | gp120/gp41 | 1.6 | 1.9 | 2.2 | 2.5 | 2.9 |
| VRC34.01 | gp120/gp41 | 0.05 | 0.07 | 0.04 | 0.07 | 0.07 |
| b12 | CD4bs | >25 | >25 | >25 | >25 | >25 |
| HJ16 | CD4bs | >25 | >25 | >25 | >25 | >25 |
| 3BNC117 | CD4bs | 0.02 | 0.01 | 0.006 | 0.003 | <0.001 |
| VRC-CH31 | CD4bs | 0.04 | 0.7 | 0.02 | 1.6 | 0.01 |
| CH103 | CD4bs | 5.3 | 2.2 | 0.63 | 0.09 | 0.48 |

TABLE 24-continued

Neutralization properties of parental and targeted glycan deleted variants of Env 426c produced in either 293T or 293S GnTI⁻ cells.

| | | | | | | |
|---|---|---|---|---|---|---|
| CH235 | CD4bs | >25 | >25 | >25 | >25 | >25 |
| CH235.12 | CD4bs | >25 | 0.26 | >25 | 0.07 | 24.2 |
| VRC01 | CD4bs | 0.19 | 0.04 | 0.04 | 0.015 | 0.007 |
| VRC03 | CD4bs | 0.014 | 0.003 | 0.005 | 0.003 | <0.002 |
| VRC04 | CD4bs | 0.18 | 0.02 | 0.05 | 0.01 | <0.002 |
| VRC07 | CD4bs | 0.07 | 0.02 | 0.05 | 0.009 | <0.002 |
| VRC018 | CD4bs | 0.06 | 0.01 | 0.02 | 0.006 | <0.002 |
| VRC20 (VRC-PG20) | CD4bs | 0.015 | 0.004 | 0.007 | 0.005 | 0.008 |
| VRC23 | CD4bs | 0.19 | 0.1 | 0.06 | 3.1 | <0.002 |
| 12A12 | CD4bs | 0.06 | 0.01 | 0.01 | 0.01 | <0.002 |
| UCA and intermediate Abs: | | | | | | |
| VRC01gHvgLv | CD4bs | >50 | 0.99 | >50 | 2.5 | 0.44 |
| VRC03gHvgLv | CD4bs | >25 | >25 | >25 | >25 | >25 |
| VRC04gHvgLv | CD4bs | >25 | >25 | >25 | >25 | >25 |
| VRC07gHvgLv | CD4bs | >25 | 0.76 | >25 | 1.6 | 1.7 |
| VRC18gHvgLv | CD4bs | >25 | >22 | >25 | 23 | 17.3 |
| VRC20 (VRC-PG20)gHvgLv | CD4bs | >25 | 10.3 | >25 | 4.6 | 0.03 |
| VRC23gHvgLv | CD4bs | >25 | >25 | >25 | >25 | >25 |
| 12A12gl | CD4bs | >25 | >25 | >25 | >25 | 0.63 |
| 3BNC117gl | CD4bs | >25 | >25 | >25 | >25 | >25 |
| CH103_UCA1.1_4A | CD4bs | nt | nt | nt | >50 | >25 |
| CH103_UCAGrand5 | CD4bs | nt | nt | nt | >50 | >25 |
| CH103_IA_9_4A | CD4bs | nt | nt | nt | >50 | >25 |
| CH103_IA_8_4A | CD4bs | nt | nt | nt | >50 | >25 |
| CH103_IA_7_4A | CD4bs | nt | nt | nt | >50 | >25 |
| CH103_IA_6_4A | CD4bs | nt | nt | nt | >50 | >25 |
| CH103_IA_5_4A | CD4bs | nt | nt | nt | >20 | >20 |
| CH103_IA_4_4A | CD4bs | nt | nt | nt | >50 | >25 |
| CH235 UCA2 | CD4bs | nt | nt | nt | >50 | >25 |
| CH235_I4_v2_4A | CD4bs | nt | nt | nt | >50 | >25 |
| CH235_I3_v2_4A | CD4bs | nt | nt | nt | >50 | >25 |
| CH235VH_I1_v2_4A | CD4bs | nt | nt | nt | >50 | >25 |
| VRC-CH31 AbCH3X_UCA | CD4bs | nt | nt | >50 | nt | >25 |
| VRC-CH31 AbCH3X_I4 | CD4bs | nt | nt | 0.018 | nt | <0.011 |
| VRC-CH31 AbCH3X_I3 | CD4bs | nt | nt | 0.021 | nt | <0.011 |
| VRC-CH31 AbCH3X_I2 | CD4bs | nt | nt | 0.02 | nt | <0.011 |
| VRC-CH31 AbCH3X_I1 | CD4bs | nt | nt | 0.032 | nt | <0.011 | nt, not tested
426c.SM (N276D)
426c.DM (N460D. N463D)
426c.TM (N276D. N460D. N463D)
426cTM4 (S278R. G471S. N460D. N463D)

Example 11

TABLE 25

Neutralization properties of parental and targeted glycan variants of CH0505TF produced in 293T and 293S GnTI⁻ cells.

Tier Phenotyping:

ID50 (dilution) in TZM-bl
293T VIRUSES

| Reagent | Epitope | CH0505TF | CH0505TF.gly4 | CH0505TF.gly3.197 | CH0505TF.gly3.276 | CH0505TF.gly3.461 | CH0505TF.G458Y | CH0505.w4.3 |
|---|---|---|---|---|---|---|---|---|
| HIV-1 sera: | | | | | | | | |
| CHAVI-0537 | Polyclonal | 56 | 352 | 266 | 456 | 211 | 711 | 23012 |
| CHAVI-0468 | Polyclonal | 980 | 55704 | 13369 | 24485 | 18158 | 3513 | 18810 |
| CHAVI-0461 | Polyclonal | 15 | 614 | 154 | 503 | 70 | 462 | 16739 |

TABLE 25-continued

Neutralization properties of parental and targeted glycan variants of CH0505TF produced in 293T and 293S GnTI- cells.

| | | | | | | | | |
|---|---|---|---|---|---|---|---|---|
| CHAVI-0383 | Poly-clonal | 68 | 990 | 595 | 262 | 459 | 675 | 13744 |
| CHAVI-0134 | Poly-clonal | 2233 | 7505 | 2106 | 9589 | 5340 | 43740 | 9533 |
| GMT | | 166 | 2456 | 927 | 1698 | 920 | 2025 | 15685 |

293S GnTI- VIRUSES

| Reagent | Epitope | CH0505TF | CH0505TF.gly4 | CH0505TF.gly3.197 | CH0505TF.gly3.276 | CH0505TF.gly3.461 | CH0505TF.G458Y |
|---|---|---|---|---|---|---|---|
| HIV-1 sera: | | | | | | | |
| CHAVI-0537 | Poly-clonal | 148 | 990 | 794 | 897 | 843 | 307 |
| CHAVI-0468 | Poly-clonal | 3245 | 66767 | 25872 | 19190 | 42286 | 43740 |
| CHAVI-0461 | Poly-clonal | 71 | 1796 | 742 | 1792 | 238 | 98 |
| CHAVI-0383 | Poly-clonal | 119 | 1228 | 723 | 709 | 685 | 183 |
| CHAVI-0134 | Poly-clonal | 38 | 600 | 15 | 514 | 338 | 113 |
| GMT | | 173 | 2446 | 698 | 1622 | 1145 | 486 |

Monoclonal Antibodies:

IC50 (µg/ml) in TZM-bl
293T VIRUSES

| | Epitope | CH0505TF | CH0505TF.gly4 | CH0505TF.gly3.197 | CH0505TF.gly3.276 | CH0505TF.gly3.461 | CH0505TF.G458Y | CH0505.w4.3 |
|---|---|---|---|---|---|---|---|---|
| Non-neutralizing Abs: | | | | | | | | |
| 2219 | V3 | >25 | >25 | >25 | >25 | >25 | >25 | >25 |
| 2557 | V3 | >25 | >25 | >25 | >25 | >25 | >25 | >25 |
| 3074 | V3 | >25 | 7.2 | >25 | 14.1 | 7.3 | 9.4 | 0.02 |
| 3869 | V3 | >25 | >25 | >25 | >25 | >25 | >25 | 3.1 |
| 447-52D | V3 | >25 | >25 | >25 | >25 | >25 | >25 | 3.7 |
| 838-12D | V3 | >25 | >25 | >25 | >25 | >25 | >25 | 14.9 |
| 654-30D | CD4bs | >25 | >25 | >25 | >25 | >25 | >25 | 0.2 |
| 1008-30D | CD4bs | >25 | >25 | >25 | >25 | >25 | >25 | 0.7 |
| 1570D | CD4bs | >25 | >25 | >25 | >25 | >25 | >25 | 0.15 |
| 729-30D | CD4bs | >25 | >25 | >25 | >25 | >25 | >25 | |
| F105 | CD4bs | >25 | >25 | >25 | >25 | >25 | >25 | 10.8 |
| bNAbs: | | | | | | | | |
| 2G12 | glycan | >25 | >25 | >25 | >25 | >25 | >25 | >50 |
| 2F5 | MPER | >25 | >25 | >25 | >25 | >25 | >25 | >25 |
| 4E1O | MPER | 22 | 14 | 21 | 17 | 16 | 8 | >50 |
| 1OE8 | MPER | 4.4 | 2.7 | 3.4 | 3.3 | 3.3 | 1.1 | 1.1 |
| DH511.2_K3 | MPER | 3.4 | 2.1 | 3.1 | 2.9 | 2.8 | 0.6 | 0.02 |
| CH01 | V2-gly | 4.1 | 8.8 | 3.8 | 5.7 | 7.7 | 1 | >20 |
| PG9 | V2-gly | 0.19 | 0.21 | 0.24 | 0.17 | 0.22 | 0.1 | 1.8 |
| PG16 | V2-gly | 0.09 | 0.1 | 0.05 | 0.1 | 0.1 | 0.03 | 0.03 |
| PGDM1400 | V2-gly | 0.006 | 0.016 | 0.01 | 0.02 | 0.04 | 0.006 | |
| PGT121 | V3-gly | >5 | >5 | >5 | >5 | >5 | >5 | >20 |
| PGT128 | V3-gly | >5 | >5 | >5 | >5 | >5 | >5 | >10 |
| 10-1074 | V3-gly | >25 | >25 | >25 | >25 | >25 | >25 | >25 |
| PGT151 | gp120/gp41 | 0.01 | 0.01 | 0.01 | 0.007 | 0.01 | 0.01 | >25 |
| VRC34.01 | gp120/gp41 | 0.55 | 0.94 | 2.1 | 0.62 | 0.84 | 0.21 | >25 |
| HJ16 | CD4bs | >25 | >25 | >25 | >25 | >25 | >25 | >25 |
| b12 | CD4bs | 0.98 | 0.004 | 0.68 | 0.007 | 0.011 | 0.1 | <0.02 |
| VRC01 | CD4bs | 0.1 | 0.002 | 0.023 | 0.004 | 1.98 | >25 | 0.05 |
| 3BNC117 | CD4bs | 0.03 | 0.001 | 0.005 | 0.001 | 0.002 | >25 | 0.02 |
| VRC-CH31 | CD4bs | 0.03 | 0.002 | 0.01 | 0.002 | 0.09 | 0.023 | 0.05 |
| CH103 | CD4bs | 1.9 | 0.002 | 1.6 | 0.014 | 0.014 | 6.4 | 0.31 |
| CH235 | CD4bs | 0.3 | 0.022 | 0.16 | 0.034 | 0.086 | 0.1 | 0.4 |
| CH235.12 | CD4bs | 0.04 | 0.001 | 0.008 | 0.001 | 0.003 | 0.014 | 0.04 |
| N6 | CD4bs | 0.06 | 0.001 | 0.01 | 0.003 | 0.004 | 0.02 | 0.01 |

TABLE 25-continued

Neutralization properties of parental and targeted glycan variants of CH0505TF produced in 293T and 293S GnTI- cells.

Germline and intermediate Abs:

| | | | | | | | | |
|---|---|---|---|---|---|---|---|---|
| VRC01/gHvgLv | CD4bs | >50 | >50 | >50 | >50 | >50 | >50 | >50 |
| CH103_UCA1.1_4A | CD4bs | >50 | >50 | >50 | >50 | >50 | >50 | 24.1 |
| CH103_UCAGrand5 | CD4bs | >50 | >50 | >50 | >50 | >50 | >50 | >50 |
| CH103_IA_9_4A | CD4bs | >50 | >50 | >50 | >50 | >50 | >50 | >50 |
| CH103_IA_8_4A | CD4bs | 25.2 | 0.002 | 8.5 | 0.002 | 0.013 | >50 | 0.95 |
| CH103_IA_7_4A | CD4bs | 4.7 | 0.002 | 5.9 | 0.001 | 0.012 | >50 | 0.2 |
| CH103_IA_6_4A | CD4bs | >50 | 0.032 | >50 | 0.047 | 0.008 | >50 | 1.5 |
| CH103_IA_5_4A | CD4bs | 7.6 | 0.003 | 2.8 | 0.002 | 0.018 | >50 | 0.19 |
| CH103_IA_4_4A | CD4bs | 3.2 | 0.001 | 0.97 | 0.004 | 0.008 | >50 | 0.25 |
| CH235 UCA2 | CD4bs | >50 | >50 | >50 | >50 | >50 | >25 | >25 |
| CH235_I4_v2_4A | CD4bs | >50 | >50 | >50 | >50 | >50 | >25 | >25 |
| CH235_I3_v2_4A | CD4bs | 5.3 | 4.1 | >50 | 1.5 | 8.6 | 1.2 | 3.0 |
| CH235VH_I1_v2_4A | CD4bs | 0.85 | 0.23 | 1.8 | 0.28 | 1.6 | 0.27 | 0.6 |
| VRC-CH31 AbCH3X_UCA | CD4bs | >25 | >25 | >25 | >25 | >25 | >25 | >25 |
| VRC-CH31 AbCH3X_I4 | CD4bs | 0.052 | <0.002 | 0.015 | 0.002 | 1.096 | 0.361 | nt |
| VRC-CH31 AbCH3X_I3 | CD4bs | 0.063 | <0.002 | 0.02 | 0.002 | 2.031 | 0.143 | nt |
| VRC-CH31 AbCH3X_I2 | CD4bs | 0.053 | <0.002 | 0.022 | 0.002 | 0.297 | 0.067 | nt |
| VRC-CH31 AbCH3X_I1 | CD4bs | 0.088 | <0.002 | 0.031 | 0.003 | >5 | 1.35 | nt |

| | | 293S GnTI- VIRUSES | | | | | | |
|---|---|---|---|---|---|---|---|---|
| | Epitope | CH0505TF | CH0505TF.gly4 | CH0505TF.gly3.197 | CH0505TF.gly3.276 | CH0505TF.gly3.461 | CH0505TF.G458Y | CH0505.w4.3 |

Non-neutralizing Abs:

| | | | | | | | | |
|---|---|---|---|---|---|---|---|---|
| 2219 | V3 | >25 | >25 | >25 | >25 | >25 | >25 | |
| 2557 | V3 | >25 | >25 | >25 | >25 | >25 | >25 | |
| 3074 | V3 | >25 | 5.6 | >25 | 4.8 | 10.2 | >25 | |
| 3869 | V3 | >25 | >25 | >25 | >25 | >25 | >25 | |
| 447-52D | V3 | >25 | >25 | >25 | >25 | >25 | >25 | |
| 838-12D | V3 | >25 | >25 | >25 | >25 | >25 | >25 | |
| 654-30D | CD4bs | >25 | >25 | >25 | >25 | >25 | >25 | |
| 1008-30D | CD4bs | >25 | >25 | >25 | >25 | >25 | >25 | |
| 1570D | CD4bs | >25 | >25 | >25 | >25 | >25 | >25 | |
| 729-30D | CD4bs | >25 | >25 | >25 | >25 | >25 | >25 | |
| F105 | CD4bs | >25 | >25 | >25 | >25 | >25 | >25 | | bNAbs:

| | | | | | | | | |
|---|---|---|---|---|---|---|---|---|
| 2G12 | glycan | >25 | >25 | >25 | >25 | >25 | >25 | |
| 2F5 | MPER | >25 | >25 | >25 | >25 | >25 | >25 | |
| 4E1O | MPER | 10 | 12.3 | 14 | 13 | 12 | 10 | |
| 1OE8 | MPER | 2.2 | 2.2 | 4 | 2.3 | 2.5 | 2.1 | |
| DH511.2_K3 | MPER | 0.95 | 1.1 | 2.5 | 1.7 | 1.6 | 1.2 | |
| CH01 | V2-gly | 0.8 | 0.1 | 0.22 | 1 | 0.09 | 0.1 | |
| PG9 | V2-gly | 0.11 | 0.02 | 0.06 | 0.04 | 0.05 | 0.04 | |
| PG16 | V2-gly | 0.08 | 0.02 | 0.03 | 0.02 | 0.02 | 0.01 | |
| PGDM1400 | V2-gly | 0.007 | 0.007 | 0.003 | 0.004 | 0.008 | 0.002 | |
| PGT121 | V3-gly | >5 | >5 | >5 | >5 | >5 | >5 | |
| PGT128 | V3-gly | >5 | >5 | >5 | >5 | >5 | >5 | |
| 10-1074 | V3-gly | >25 | >25 | >25 | >25 | >25 | >25 | |
| PGT151 | gp120/gp41 | >5 | 0.13 | >5 | >5 | >5 | >5 | |
| VRC34.01 | gp120/gp41 | 0.1 | 0.14 | 0.17 | 0.14 | 0.17 | 0.03 | |
| HJ16 | CD4bs | >25 | >25 | >25 | >25 | >25 | >25 | |
| b12 | CD4bs | 0.61 | 0.001 | 0.26 | 0.01 | 0.02 | 0.22 | |
| VRC01 | CD4bs | 0.03 | 0.001 | 0.009 | 0.003 | 0.015 | 0.91 | |
| 3BNC117 | CD4bs | 0.01 | 0.001 | 0.004 | 0.001 | 0.002 | 18 | |
| VRC-CH31 | CD4bs | 0.04 | 0.001 | 0.01 | 0.001 | 0.007 | 0.06 | |
| CH103 | CD4bs | 0.57 | 0.005 | 0.19 | 0.007 | 0.009 | 0.44 | 0.18 |
| CH235 | CD4bs | 0.03 | 0.004 | 0.006 | 0.02 | 0.011 | <0.02 | 0.03 |
| CH235.12 | CD4bs | 0.015 | 0.001 | 0.003 | 0.005 | 0.002 | 0.003 | 0.01 |
| N6 | CD4bs | 0.016 | 0.001 | 0.003 | 0.004 | 0.002 | 0.008 | |

Germline and intermediate Abs:

| | | | | | | | | |
|---|---|---|---|---|---|---|---|---|
| VRC01/gHvgLv | CD4bs | >50 | >50 | >50 | >50 | >50 | >50 | >50 |
| CH103_UCA1.1_4A | CD4bs | >50 | 6.4 | >50 | >50 | 10.2 | >50 | 14.5 |
| CH103_UCAGrand5 | CD4bs | >50 | >50 | >50 | >50 | >50 | >50 | >50 |

TABLE 25-continued

Neutralization properties of parental and targeted glycan variants of CH0505TF produced in 293T and 293S GnTI⁻ cells.

| | | | | | | | | |
|---|---|---|---|---|---|---|---|---|
| CH103_IA_9_4A | CD4bs | >50 | >50 | >50 | >50 | >50 | >50 | >50 |
| CH103_IA_8_4A | CD4bs | 0.55 | 0.001 | 0.14 | 0.002 | 0.003 | 2 | 0.21 |
| CH103_IA_7_4A | CD4bs | 0.13 | 0.001 | 0.02 | 0.002 | 0.003 | 0.9 | 0.08 |
| CH103_IA_6_4A | CD4bs | 0.64 | 0.001 | 2.2 | 0.001 | 0.002 | 8.7 | 1.04 |
| CH103_IA_5_4A | CD4bs | 0.46 | 0.002 | 0.48 | 0.003 | 0.005 | 12.7 | 0.09 |
| CH103_IA_4_4A | CD4bs | 0.19 | 0.001 | 0.035 | 0.001 | 0.002 | 1 | 0.08 |
| CH235 UCA2 | CD4bs | >50 | >50 | >50 | >50 | >50 | 0.16 | >25 |
| CH235_I4_v2_4A | CD4bs | 1.4 | >50 | >50 | >50 | >50 | 0.08 | 1.7 |
| CH235_I3_v2_4A | CD4bs | 0.12 | 0.8 | 0.018 | 0.35 | 0.44 | 0.03 | 0.1 |
| CH235VH_I1_v2_4A | CD4bs | 0.05 | 0.24 | 0.022 | 0.1 | 0.31 | <0.02 | 0.04 |
| VRC-CH31 AbCH3X_UCA | CD4bs | >25 | >25 | >25 | >25 | >25 | >25 | nt |
| VRC-CH31 AbCH3X_I4 | CD4bs | 0.008 | <0.002 | 0.004 | 0.002 | 0.025 | 0.004 | nt |
| VRC-CH31 AbCH3X_I3 | CD4bs | 0.01 | <0.002 | 0.003 | 0.002 | 0.06 | 0.004 | nt |
| VRC-CH31 AbCH3X_I2 | CD4bs | 0.009 | <0.002 | 0.004 | 0.002 | 0.01 | 0.002 | nt |
| VRC-CH31 AbCH3X_I1 | CD4bs | 0.014 | <0.002 | 0.005 | 0.003 | 0.357 | 0.009 | nt |

Example 11

TABLE 26

CH235 UCA2 does not neutralize targeted glycan deleted CH0505TF.G458Y.

| | | IC50 (µg/ml) in TZM-bl cells | |
|---|---|---|---|
| Reagent | Epitope | 293T CH0505TF.gly4.G458Y | 293S GnTI⁻ CH0505TF.gly4.G458Y |
| CH235 UCA2 | CD4bs | >10 | >10 |
| CH235_I4_v2_4A | CD4bs | >10 | >10 |
| CH235_I3_v2_4A | CD4bs | 0.37 | 0.07 |
| CH235VH_I1_v2_4A | CD4bs | 0.016 | 0.005 |
| CH235 | CD4bs | 0.064 | <0.005 |
| CH235.12 | CD4bs | <0.005 | <0.005 |

Positive values are shown in boldface type

Example 11

TABLE 27

G458 mutations that permit neutralization by CH235 UCA2.

| | | IC50 (µg/ml) in TZM-bl cells Mutation in CH0505TF (Env-pseudotyped viruses produced 293S GnTI⁻ cells) | | | | |
|---|---|---|---|---|---|---|
| Antibody | Epitope | G458Y | G458F | G458W | G458R | G458K |
| CH235 UCA2 | CD4bs | 0.200 | 0.746 | 1.069 | 0.916 | >10 |
| CH235_I4_v2_4A | CD4bs | 0.146 | 0.249 | 0.012 | 0.238 | 0.798 |
| CH235_I3_v2_4A | CD4bs | 0.017 | 0.011 | 0.005 | 0.025 | 0.025 |
| CH235VH_I1_v2_4A | CD4bs | 0.009 | 0.009 | 0.006 | 0.012 | 0.019 |
| CH235 | CD4bs | <0.005 | <0.005 | <0.005 | <0.005 | 0.022 |
| HIV-1 Serum | | | | | | |
| CHAVI-0537 | Polyclonal | 124 | 157 | 174 | 160 | 192 |
| CHAVI-0468 | Polyclonal | 8257 | 9993 | 16153 | 5371 | 4533 |
| CHAVI-0461 | Polyclonal | 72 | 109 | 108 | 149 | 160 |
| CHAVI-0383 | Polyclonal | 155 | 216 | 236 | 224 | 209 |
| CHAVI-0134 | Polyclonal | 80 | 121 | 85 | 83 | 102 |
| GMT[1] | | 247 | 339 | 361 | 299 | 312 |

| Antibody | Epitope | G458C | G458L | G458S | G458D | G458E | G458Y.N280D |
|---|---|---|---|---|---|---|---|
| CH235 UCA2 | CD4bs | 0.391 | 0.555 | >10 | >10 | >10 | >10 |
| CH235_I4_v2_4A | CD4bs | 0.103 | 0.169 | 0.901 | 6.542 | >10 | >10 |
| CH235_I3_v2_4A | CD4bs | 0.026 | 0.025 | 0.025 | 0.066 | 0.036 | 0.771 |
| CH235VH_I1_v2_4A | CD4bs | 0.017 | 0.018 | 0.013 | 0.033 | 0.014 | 0.260 |
| CH235 | CD4bs | 0.009 | 0.015 | 0.005 | 0.011 | 0.012 | 2.691 |

TABLE 27-continued

G458 mutations that permit neutralization by CH235 UCA2.

HIV-1 Serum

| CHAVI-0537 | Polyclonal | 186 | 293 | 219 | 346 | 197 | nt |
| CHAVI-0468 | Polyclonal | 8854 | 7048 | 10905 | 141222 | 14778 | nt |
| CHAVI-0461 | Polyclonal | 149 | 274 | 124 | 184 | 124 | nt |
| CHAVI-0383 | Polyclonal | 196 | 154 | 255 | 297 | 301 | nt |
| CHAVI-0134 | Polyclonal | 129 | 81 | 112 | 216 | 78 | nt |
| GMT[1] | | 362 | 371 | 385 | 896 | 385 | nt |

[1]GMT, geometric mean titer of polyclonal sera

Example 12: CH235UCA Versions and Purification

Several CH235UCAs were deduced, made and used in experiments throughout this application.

Table 28 shows a summary of the different CH235UCAs. Sequences are referenced in Examples 8 and 11, and shown in FIG. 59.

| CH235 UCA Name | VH | VL | Lot |
|---|---|---|---|
| CH235UCA_LL | CH235HUCA_4A | CH235KUCA | 217SJA |
| DH235UCAtk_v2_4A/293i (also referred to as CH235UCAtk_v2 referenced in Ex 8) | DH235VH_UCAtk_v2_4A | DH235VK_UCAtk | 5RKK |
| DH235UCAtkLL_v3_4A/293i (also referred to as CH235UCAtkLL_v3 and CH235UCA2) | DH235VH_UCAtk_v2_4A | CH235KUCA | 48EML |

In some experiments, e.g. experiments depicted in Examples 10 and 11 CH235 UCA forms were recombinantly expressed and purified without size exclusion chromatography step.

Figure 41:
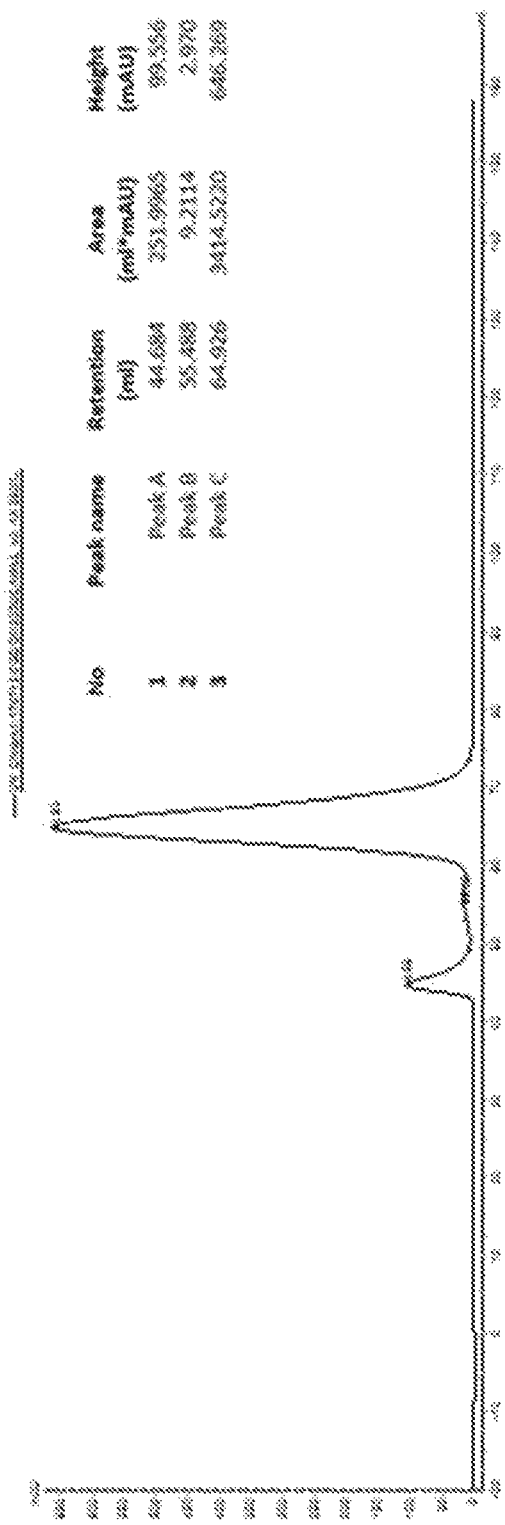
FIG. 41 shows a lot (165CGD) of DH235UCAtkLL_v3_4A/293i when it was run over SEC resin. The SEC chromatogram shows a main peak, and high molecular forms. Another lot (48 EML) of DH235UCAtkLL_v3_4A/293i has a similar profile.
Figure 42:
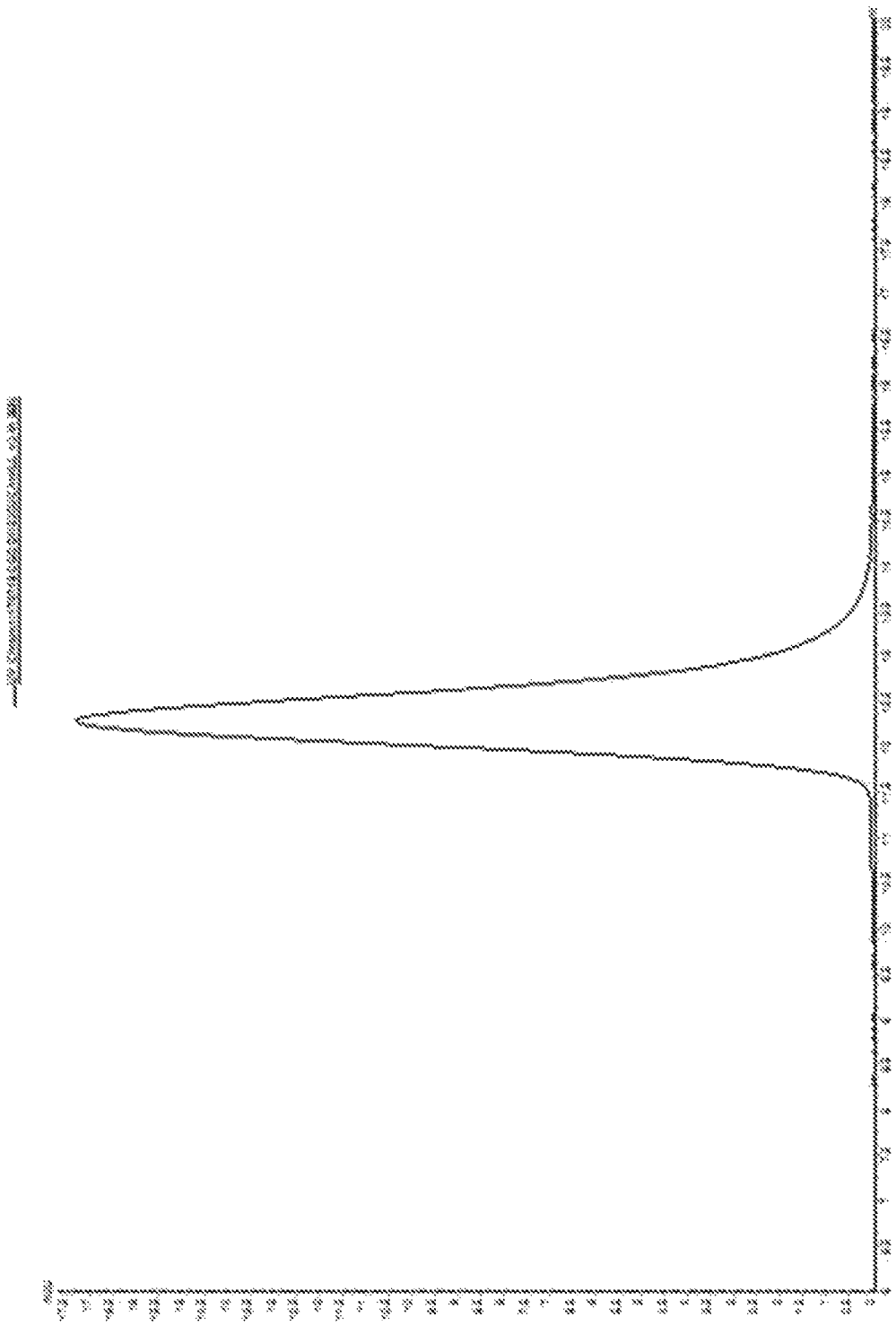
FIG. 42 shows the SEC profile of the main peak/fraction of DH235UCAtkLL_v3_4A/293i (lot 170712PPF). Antibody purified over SEC resin is described in Example 13. In some instances, this SEC antibody is referred as a purified antibody.

FIG. 41 shows that in the absence of size exclusion chromatography step, high molecular weight forms of CH235UCAtkLL_v3 are observed in addition to the main antibody peak. The main peak was isolated and FIG. 42 shows a single antibody peak after size exclusion chromatography purification.

Figure 44:
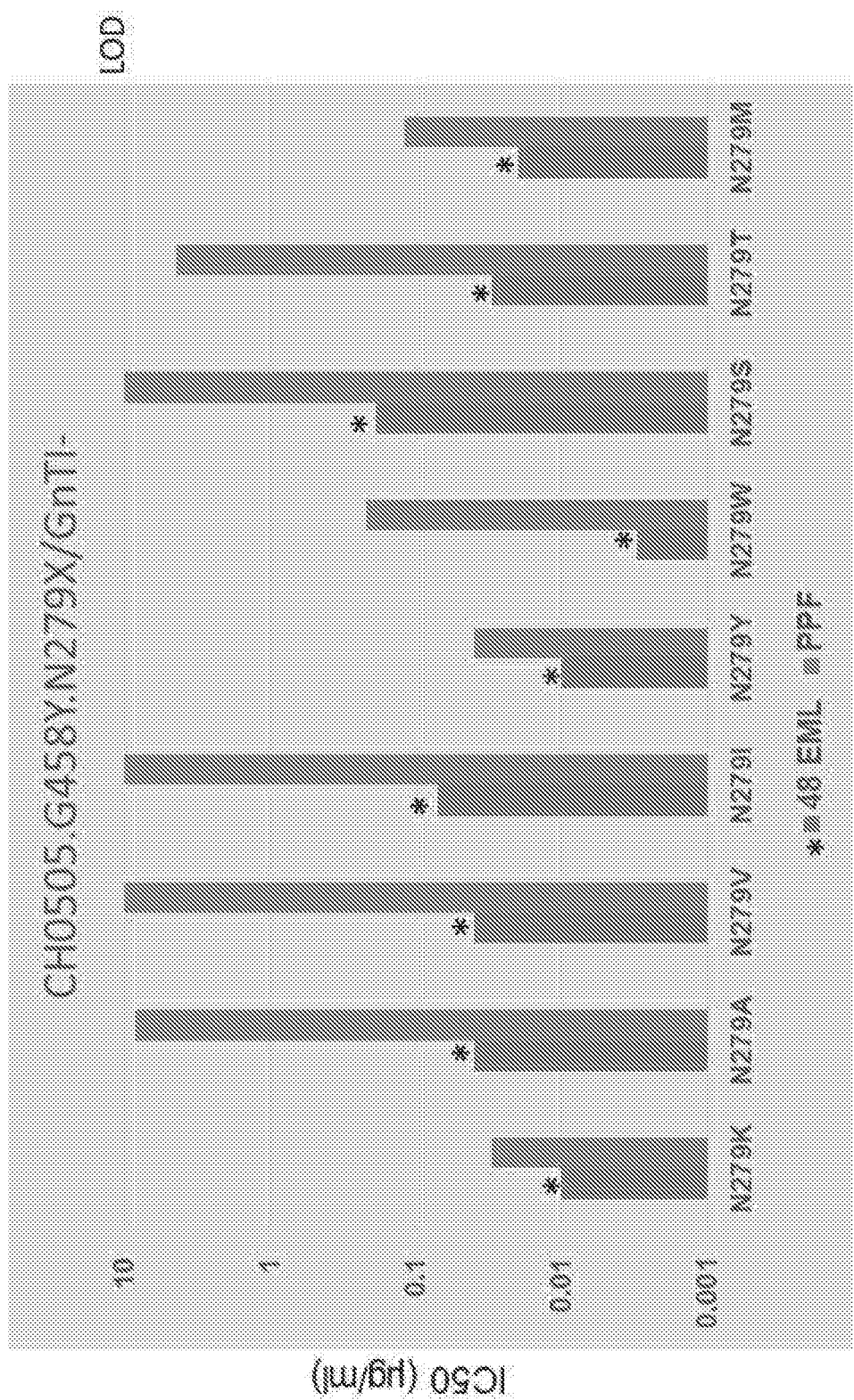
FIG. 44 shows comparison neutralization ($IC_{50}$) values) of two lots of DH235UCAtkLL for neutralization of various CH505 viruses. Viruses are listed in the x-axis—N279X refers to various amino acids changes at position 279. Lot 48EML was not purified by SEC, and lot 170712PPF was purified by SEC (See FIGS. 41 and 42).
Figure 45A:
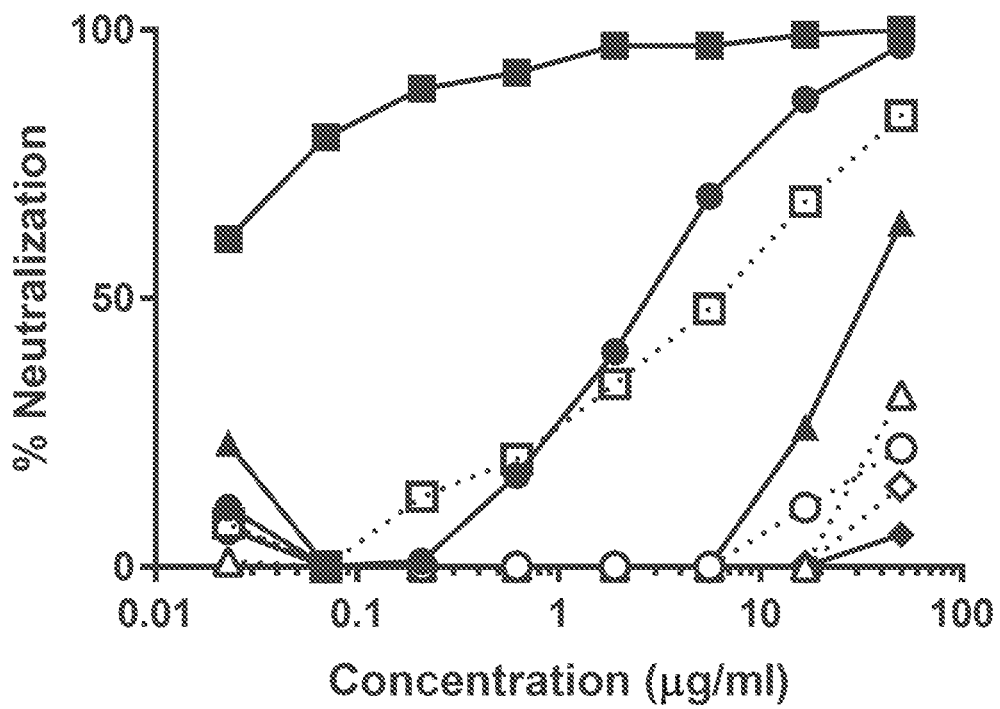
FIG. 45A shows neutralization results with SEC purified DH235UCAtkLL_v3_4A. Viruses and $IC_{50}$ values are listed in FIG. 45B. CH0505TF.M5 refers to CH505M5.
Figure 45B:

Some experiments in Example 13 compared the properties of the SEC-purified antibody and non-SEC purified CH235UCAtkLL_v3 antibody. In some embodiments, the SEC purification affects binding and neutralization properties. For example, SEC purified CH235UCA antibody shows reduced neutralization and binding, whether or not the viruses are produced in GnTI−/− cells. See FIG. 43 and FIG. 44 where Lot 48EML was not purified by SEC, and lot 170712PPF was purified by SEC (See FIGS. 41 and 42).

Experiments in Example 13 are conducted with SEC purified antibody unless noted otherwise. In some of the figures, and in Examples 13 the size exclusion chromatography purified antibody is referred to as purified antibody.

Example 13

Germline-Targeting and Reverse Engineering to Elicit CH235.12 Lineage BNAbs

This example provides some strategies and non-limiting embodiments of immunogens to induce broad neutralizing antibodies, including CH235 lineage of antibodies.

The ability to stimulate germline B cells that give rise to broadly neutralizing antibodies (bNAbs) is a major goal for HIV-1 vaccine development. bNAbs that target the CD4-binding site (CD4bs) and exhibit extraordinary potency and breadth of neutralization are particularly attractive to elicit with vaccines. Glycans that border the CD4bs and impede the binding of germline-reverted forms of CD4bs bNAbs are potential barriers to naïve B-cell receptor engagement. We used pseudovirus neutralization as a means to identify Env modifications that permit native Env trimer binding to germline reverted CD4bs bNAb CH235.12 (VH1-46). Two mutations (N279K.G458Y), when combined with Man5-enrichment of N-linked glycans that are otherwise processed into complex glycans, rendered autologous CH0505TF Env highly sensitive to neutralization by CH235.12 UCA. These findings suggest a vaccine Example 8 described a bnAb, CH235.12, which has ~90% breadth, and uses VH1-46 chain. The deduced UCA for this lineages, CH235UCA does not neutralize wild type virus. Without bound by specific theory, virus modifications that permit neutralization would be candidate germline-targeting immunogens. This information also suggests reverse-engineering strategies to mature the response.

In some aspects, the goal was to identify Env modifications that permit neutralization by germline-reverted CD4bs bNAbs. In some embodiments, the hypothesis was that conversion of bulky complex-type glycans to smaller Man5GlcNac2 glycoforms will reduce steric barriers to germline BNAb binding without disrupting native Env conformation.

Previous work has explored glycan modifications and has shown that deletion of a subset of glycans surrounding the CD4bs is a feature that has permitted binding and BCR activation by germline-reverted forms of VRC01-class BNAbs. See McGuire et al., J Exp Med, 210:655-663, 2013; McGuire et al., Nat Comm 7:10618, 2016; Jardine et al., Science 340, 711-716, 2013; Jardine et al., Science 349, 156-161, 2015; Jardine et al., Science 351, 1458-1463, 2016.

See also Zhou, T. et al. Cell Reports 19:719-732, 2017 where inter alia CH0505TF; CH0505TF.gly4 (deleted N197, N276, N461, naturally lacks N362); CH0505TF.gly3.197; CH0505TF.gly3.276; CH0505TF.gly3.461 were studied. Man5-enriched versions of these viruses were not neutralized by CH235UCA. Man5-enriched CH0505TF was highly sensitive to CH235 intermediates. Glycan deletion did not improve neutralization by CH235 intermediates Induction of VH1-46 utilizing CD4 binding site (CD4bs) ANC131, CH235-class broadly reactive neutralizing antibodies (bnAbs) is desirable because the affinity matured antibodies of this class are quite broad and potent, are not autoreactive, nor have long HCDR3 regions, and, in the case of CH235, do not have difficult to induce insertions or deletions that need to occur en route to bnAb breadth (Cell 165: 449-463, 2016). However, there are only a few of these bnAbs described and only one bnAb lineage isolated from the time of acute infection to bnAb breadth, CH235 lineage (Cell 165: 449-463, 2016). Moreover, Envs that bind to the CH235 UCA at high affinity have not been available. Here, we show that deletion of certain glycans and inclusion of a G458Y mutation creates a CH505 M5 Envelope from a low affinity binding Env to a high affinity binding Env for the CH235 UCA.

Figure 59F:
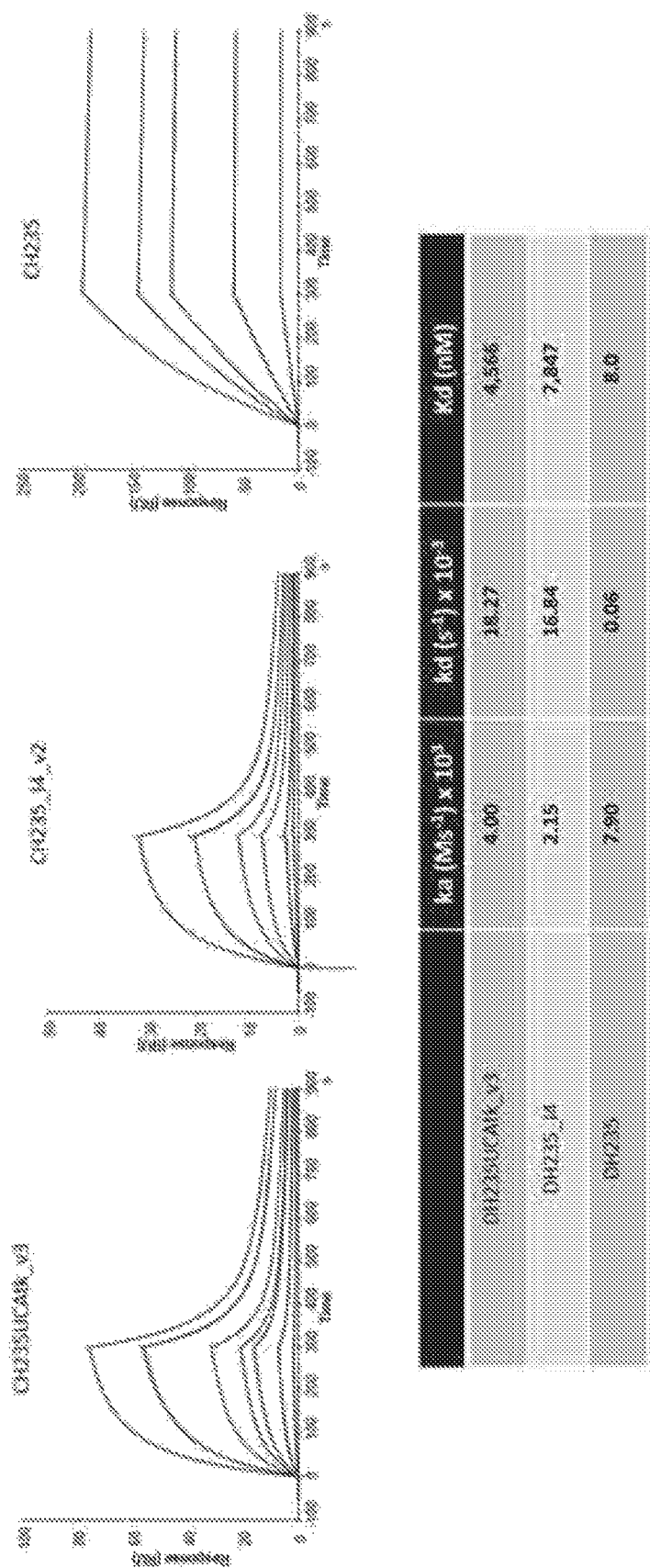
FIG. 59F shows CH505 M5 gp120 produced at the DHVI GMP Facility binds to the CD4 binding site CH235 UCA with a Kd of 4,566 nM while the mature bnAb CH235 binds with at Kd of 8.0 nM.

Effect of Affinity of Immunizing Antigens on Induction of Germinal Center (GC) Responses The affinity of stimulating antigens has a profound effect on the outcome of the germinal center response. High affinity antigens can prevent a B cell from staying in the germinal center, and promote rapid maturation of a B cell to a short-lived plasma cell (Journal of Exp. Med. 203: 1081, 2006). Recent data suggest that affinities from high microM to low nM can activate bnAb precursors, but the key is what the affinity of sequential Env immunogens must be to retain stimulated bnAb B cell lineages in the germinal center. To this end, we have selected and produced at the Duke Human Vaccine Institute (DHVI) CGMP facility the M5 gp120 that has an apparent affinity for the CH235 UCA of 4.6 microM while the mature CH235 bnAb has an affinity of 8.0 nM for the M5 gp120 Env (FIG. 59F). Thus, in some embodiments the M5 gp120 could be a "low affinity" immunogen to determine its effectiveness in initiating CH235-like VH1-46 CD4bs antibody B cell lineages.

Figure 58A:
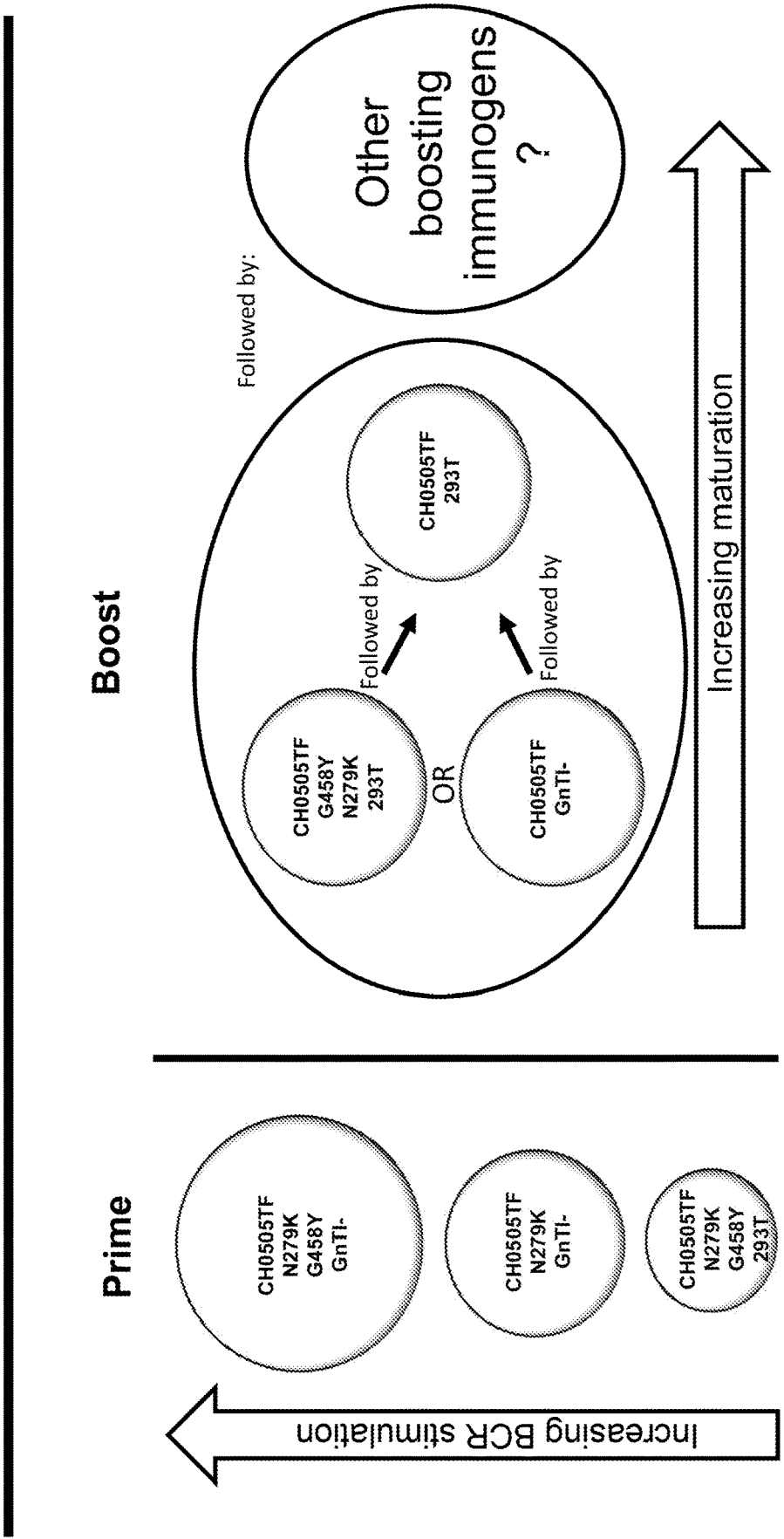
FIGS. 58A and 58B show some embodiments of an immunization strategies to elicit CH235.12-like BNAbs. CH505 T/F N279K has the sequence and is also referred to as CH505 M5 envelope. In certain embodiments, the immunogens listed under prime are administered individually. In certain embodiments, the immunogens listed under prime are administered sequentially as any combination of two immunogens or the combination of three. In certain embodiments, the immunogens listed under prime are administered sequentially starting with the immunogen with lowest affinity (e.g. CH505 T/F N279K G458Y grown in 293T cells). In certain embodiments, the immunogens under prime are administered sequentially starting with the immunogen with highest BCR affinity (e.g. CH505 T/F N279K G458Y grown in GnTI–/– cells). In certain embodiments, the immunogens under "boost" are administered as follows: CH0505TF G458Y N279K grown in 293T cells followed by CH505 T/F grown in 293T cells. In certain embodiments, the immunogens under "boost" are administered as follows: CH0505TF GnTI–/– followed by CH505 T/F grown in 293T cells.
Figure 58B:
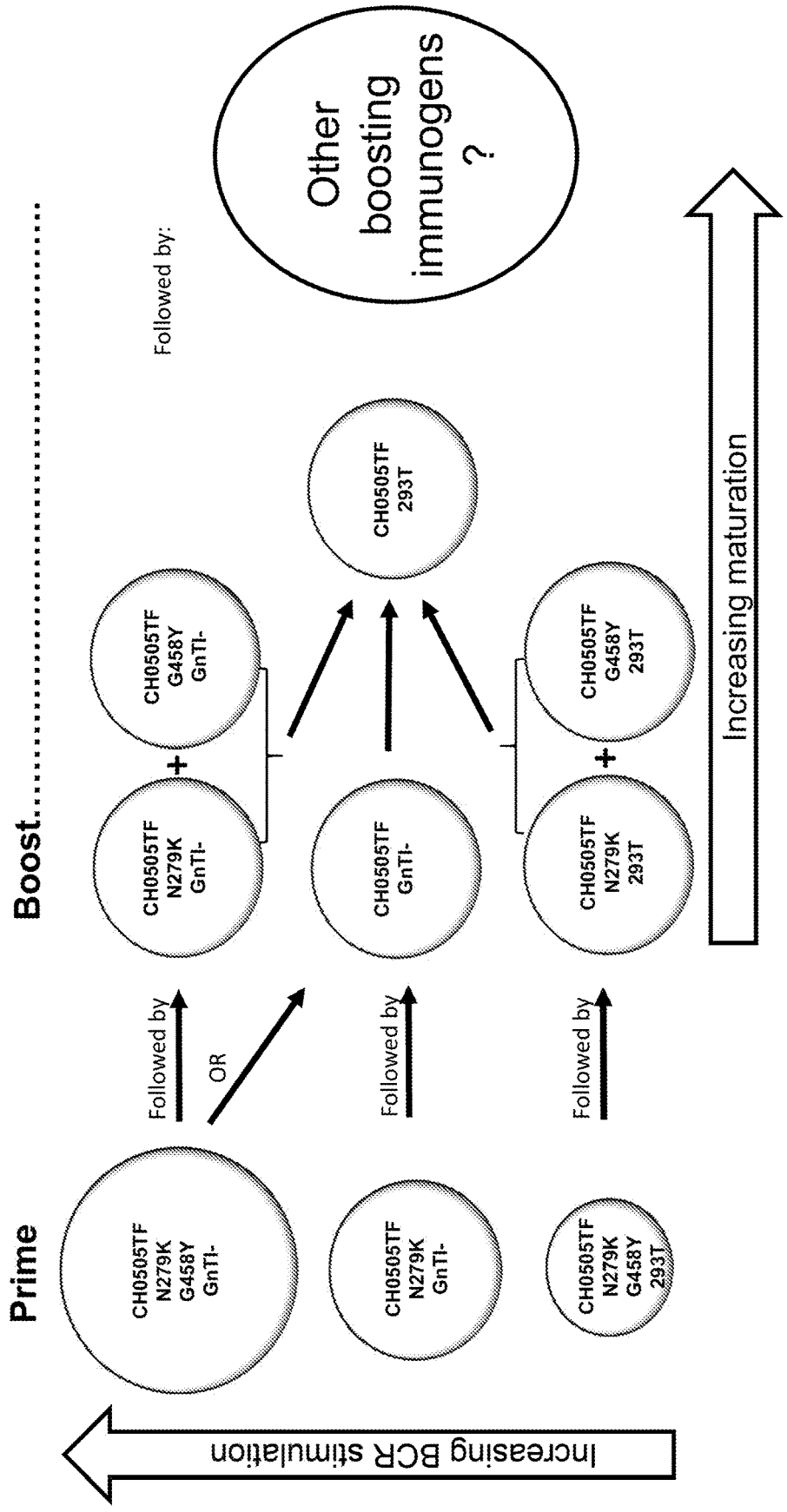

For additional immunization strategies see also FIG. 58 and accompanying description.

Figures 46, 47:
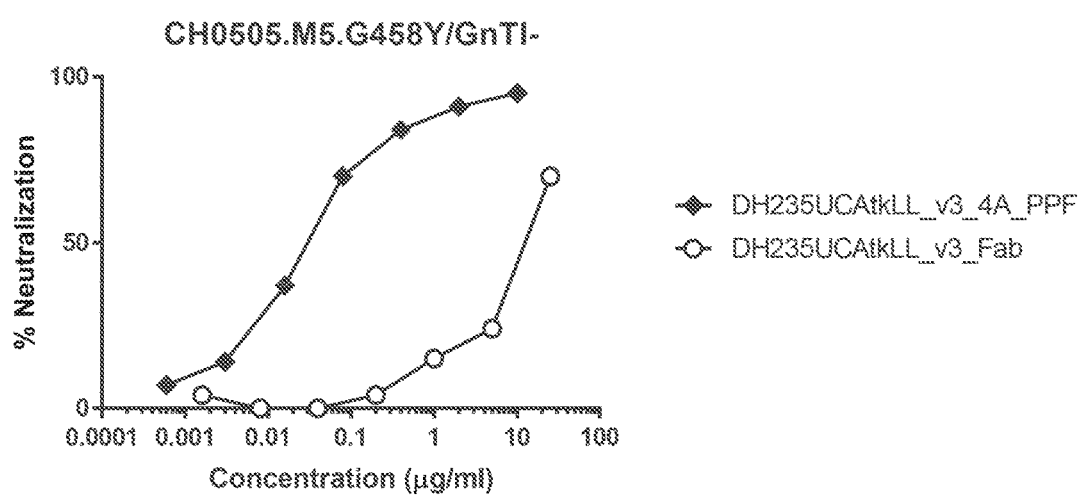
FIG. 46 shows binding of CH235UCA to various CH505 SOSIPs. The envelope marked with * was also used in cryoEM studies. This figure shows that neutralization Predicts nM Affinity Binding to CH0505 SOSIP.
FIG. 47 shows that DH235UCAtkLL Fab potency is remarkably weak compared to IgG (>2 log reduction in IC50).
Figure 54:
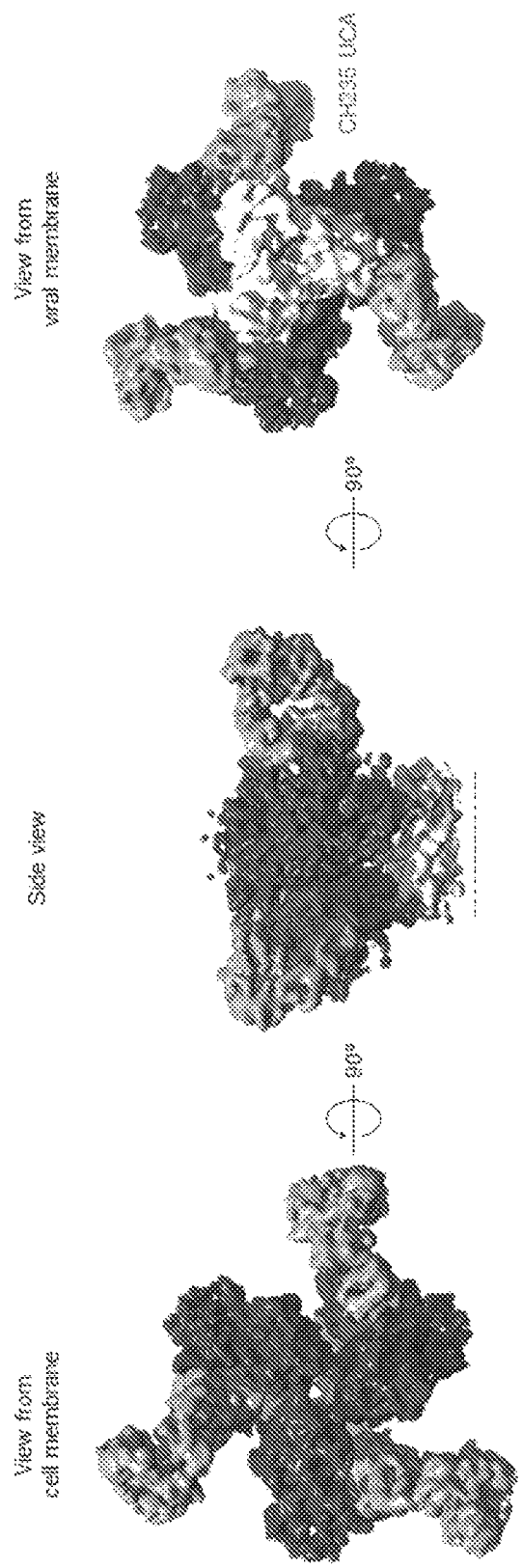
FIG. 54 shows Cryo-EM Structure of CH235 UCA bound to HIV-1 Env CH505M5chim.6R.SOSIP.664v4.1_G458Y/GnTi− at 5.4 Å resolution. The 3D class averages show 3 Fa bound trimer. These classes have structural difference and could not be aligned together. At the observed resolution, most side chains and glycans could not be visualized.
Figure 55:
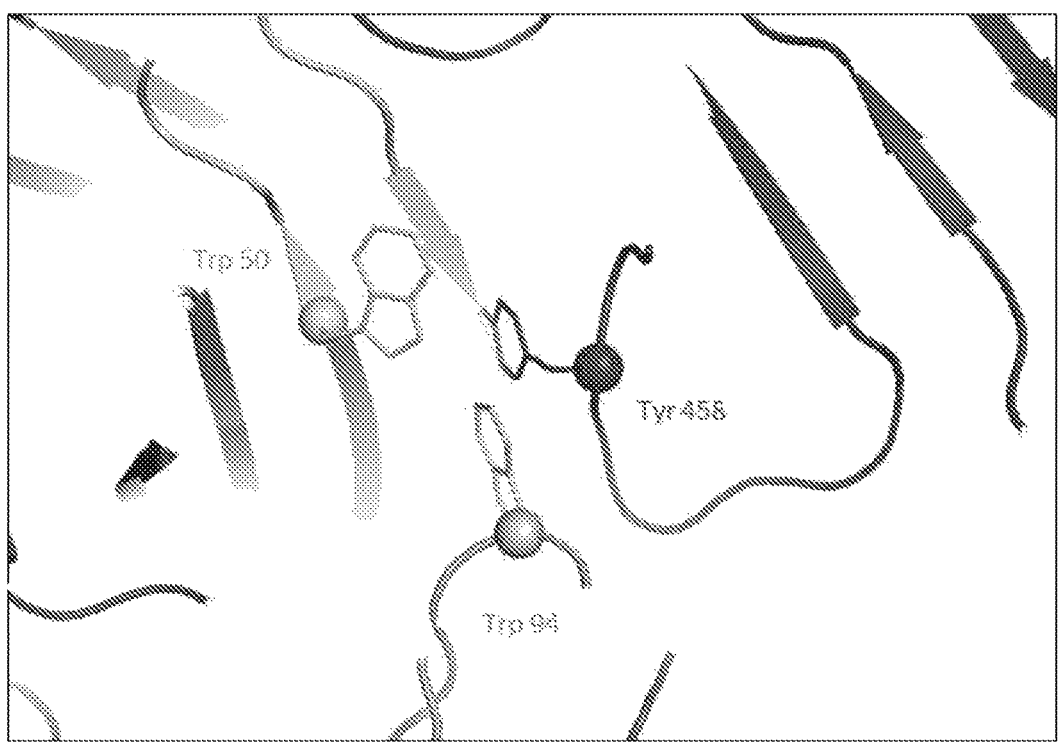
FIG. 55 shows a detail of interaction between CH235 UCA and envelope. In this model. Y458 interacts with W50 (CDR H2) and W94 (CDR L3). Other bulky and hydrophobic residues (or Arg, which can form a pi-cation interaction with the two Trps) at position 458 are expected to stabilize this interaction as well.
Figure 56:
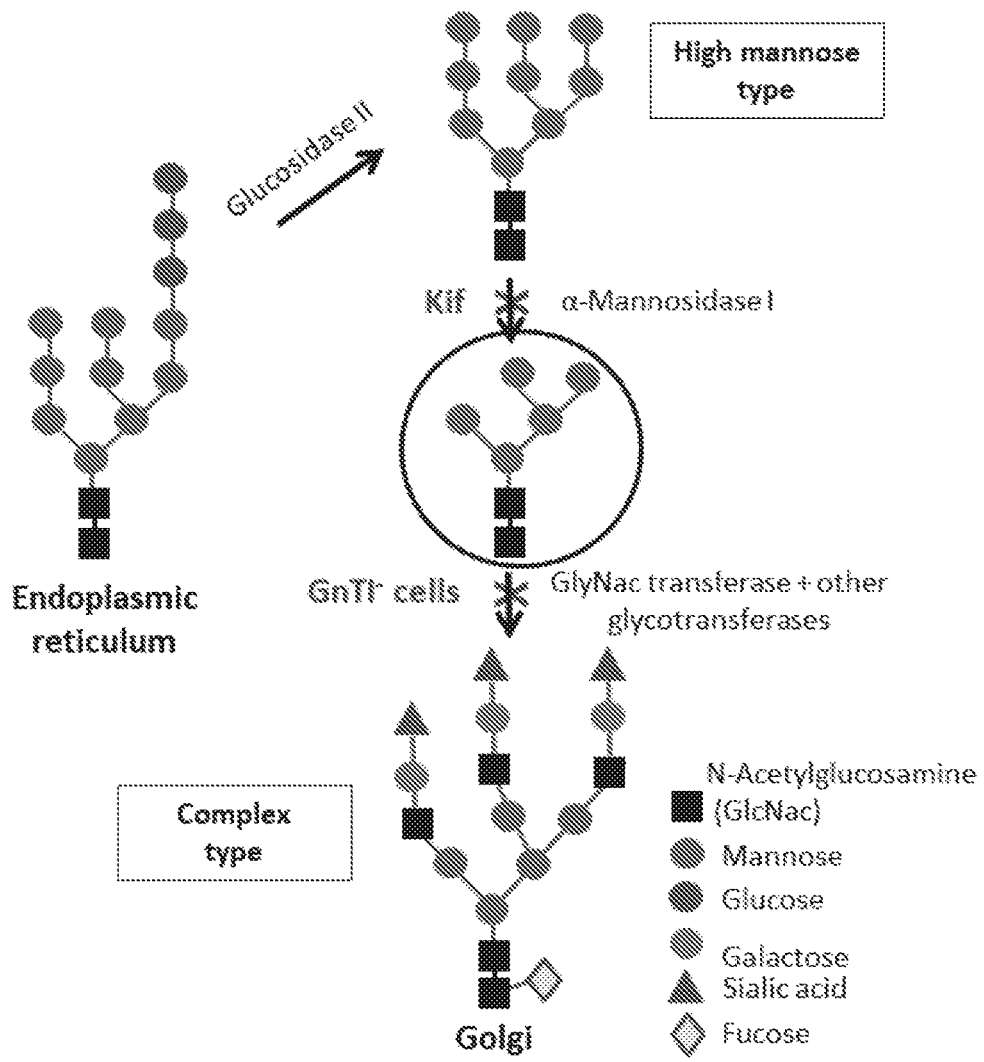
FIG. 56 shows Derivation of Man5-Enriched Glycans on HIV-1 Env.
Figure 57:
FIG. 57 shows summary of data suggesting that VRC01 resistance mutations are potential germline targeting mutations for CH235.12 lineage.

Design of the CH505 M5 G458Y Stabilized SOSIP Trimer that Targets the CH235 UCA at Various Affinity To design an additional "high affinity" immunogen capable of binding to the CH235 UCA at nM affinity, mutations that might increase binding of the CH235 UCA to Env based on the CH235-Env co-crystal structure (Cell 165: 449-463, 2016) were studied. The CH505 M5 Env expressed as a stabilized (4.1) SOSIP trimer bound to the CH235 UCA with an apparent Kd of 231 nM (FIG. 46). It was found that the G458Y Env mutation increased the apparent affinity of the CH235 UCA to 89 nM, and the M5 virus with this mutation was able to be neutralized by the CH235 UCA (FIG. 46). Study of this Env with CH235 UCA using CryoEM demonstrated that 458Y interacted with W50 in the CH235 UCA, and thus was a stabilizing mutation for this interaction (FIGS. 54, 55).

Non-limiting examples of neutralization of envelopes comprising G458Mut are shown in FIG. 89. In some embodiments envelopes comprising G458C or G458L mutation will be analyzed further in various assay, including SPR, immunogenicity and so forth. In some embodiments these envelopes also comprise N279X, wherein examples of X are show in FIG. 90.

Non-limiting examples of neutralization of envelopes comprising amino acids other than lysine (K) at Env position 279 are shown in FIG. 90.

Multimerization of CH505 M5 G458Y Env

Figure 60A:
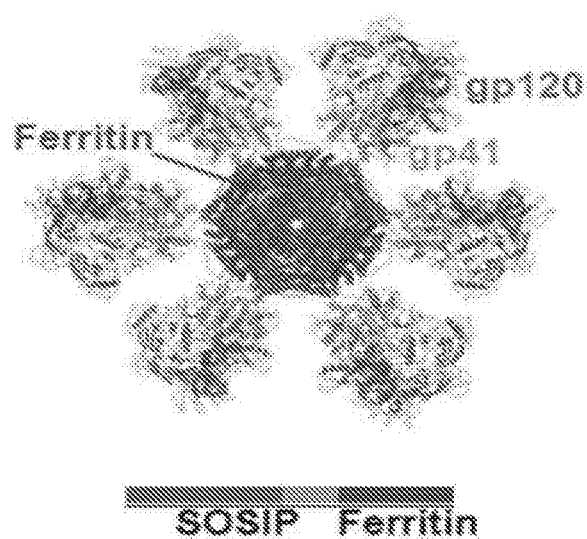
FIG. 60A shows a model of M5 SOSIP Ferritin particle with 6 Env trimers displayed, based on ferritin and SOSIP trimer crystal structures.
Figure 60B:
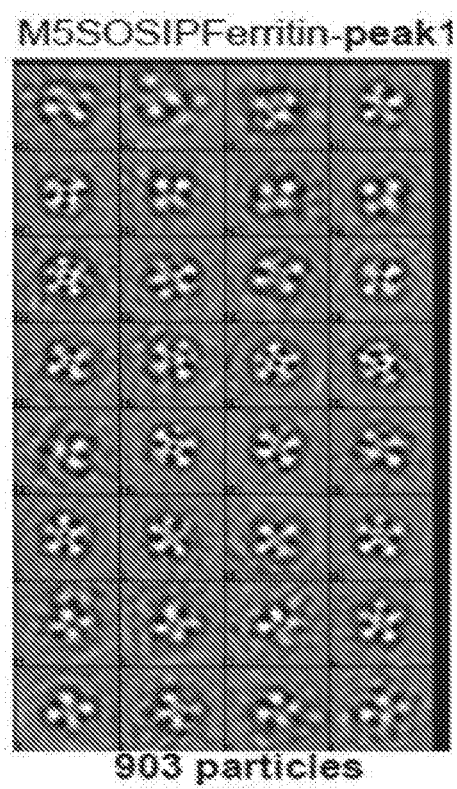
FIG. 60B shows negative stained EMs of M5 SOSIP Ferritin particles purified by size exclusion chromatography. The number of particles vary because of the variability of orientation of the particles on the EM grid.
Figure 61:
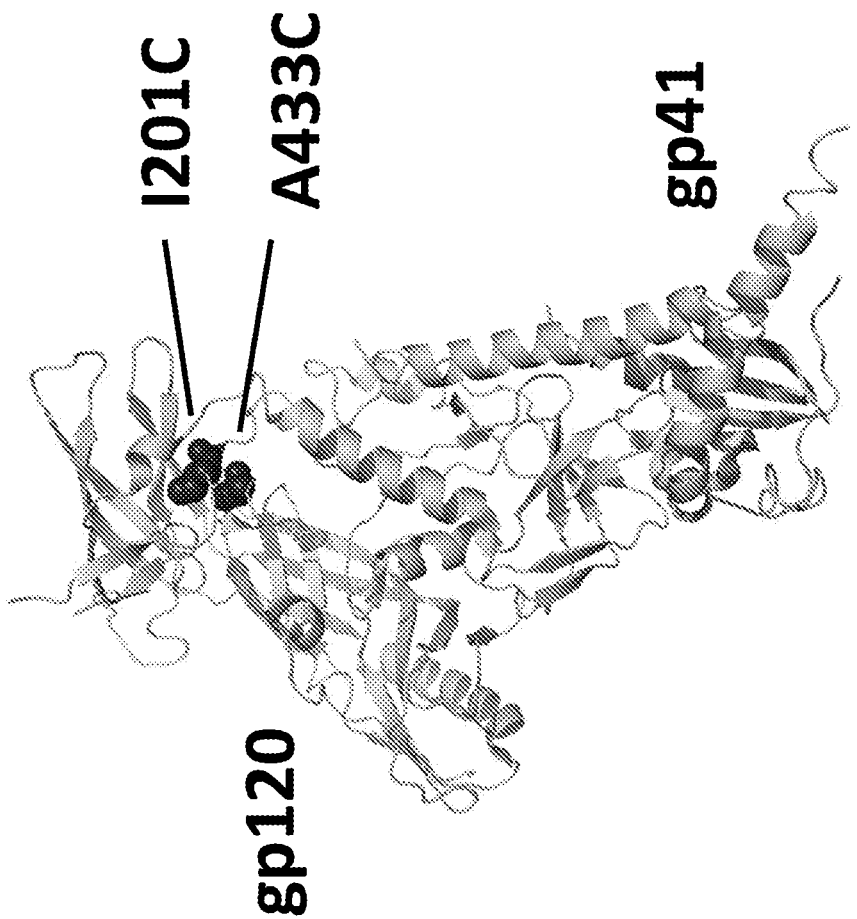
FIG. 61 shows stabilization of chimeric CH505 TF SOSIP gp140. The introduction of a cysteine at positions 201 and 433 formed a disulfide bond that stabilized the trimer in the pre-CD4 bound conformation (Nat Struct Mol Biol. 2015 July; 22(7): 522-531). This mutation was also added to further stabilize the CH505 chimeric SOSIP.
Figure 62:
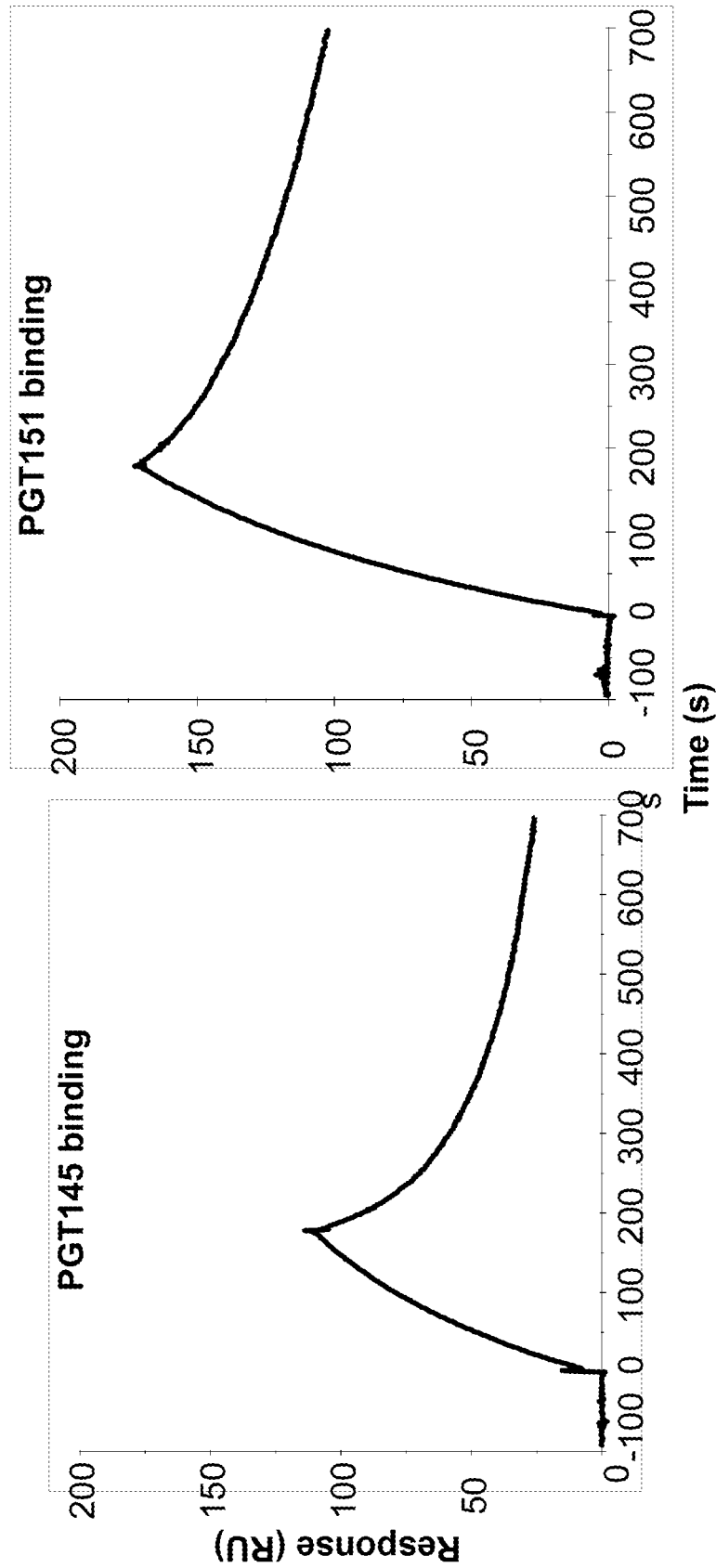
FIG. 62 shows CH505 SOSIP.I binds to trimer-specific bnAbs. The chimeric CH505 TF SOSIP.I was produced and tested for binding to trimer specific bnAbs. In SPR assays, CH505 bound both PGT145 and PGT151.
Figure 63:
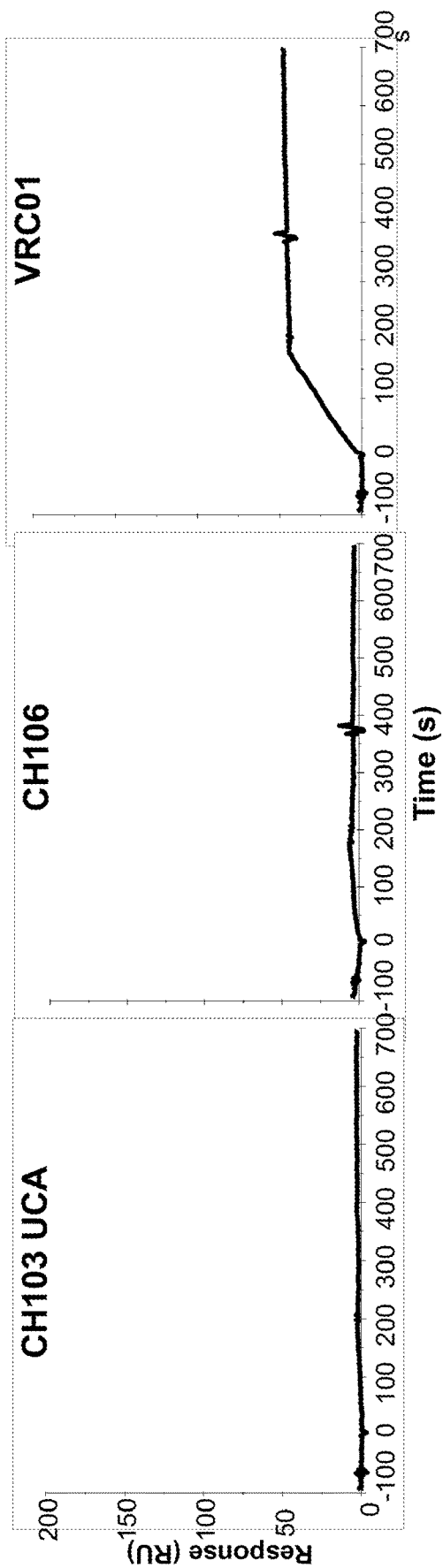
FIG. 63 shows SOSIP.I—stabilization of the trimer to reduce CD4 binding also disrupts binding by the CH103 lineage. When the UCA of the CH103 lineage or a mature bnAb from the lineage CH106 was assessed for binding to the CH505 TF SOSIP.I neither antibody bound to the trimer. In contrast the CD4 mimicking antibody VRC01 was still able to bind.
Figure 64:
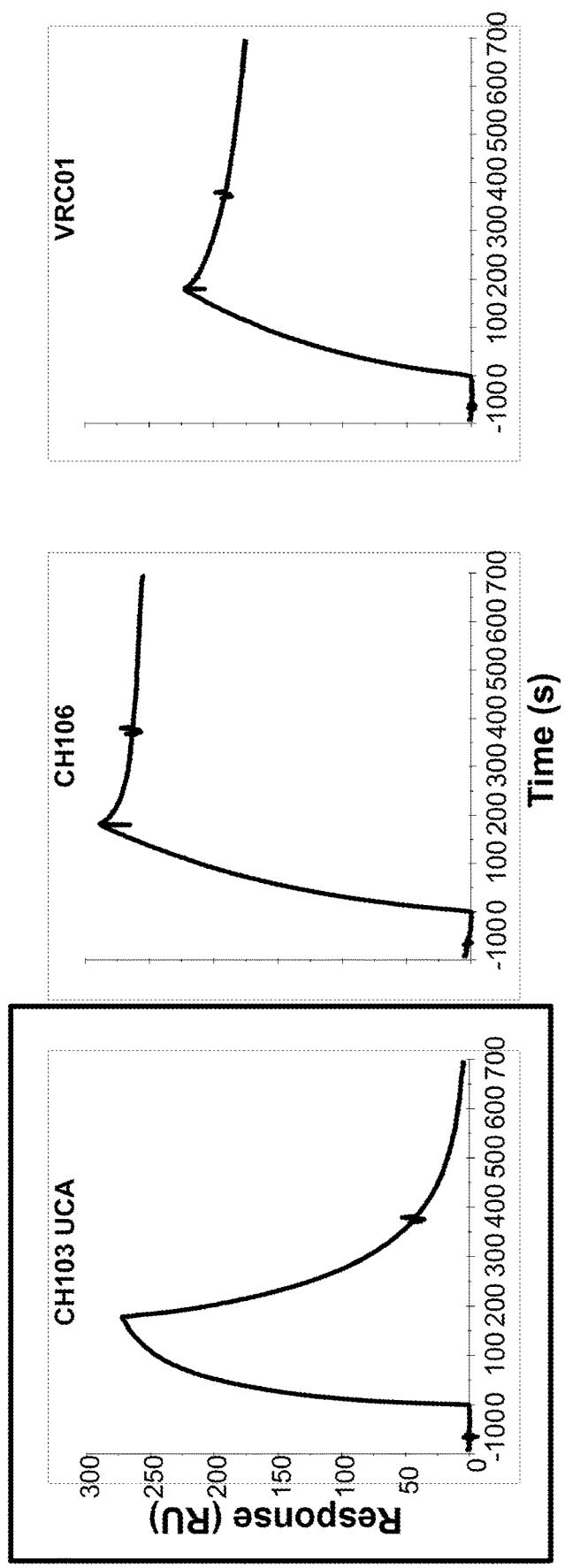
FIG. 64 shows CH103 UCA binds the CH505 transmitted founder gp120. The monomeric CH505 TF gp120 binds to the CH103 UCA by SPR as shown in the box.
Figure 65:
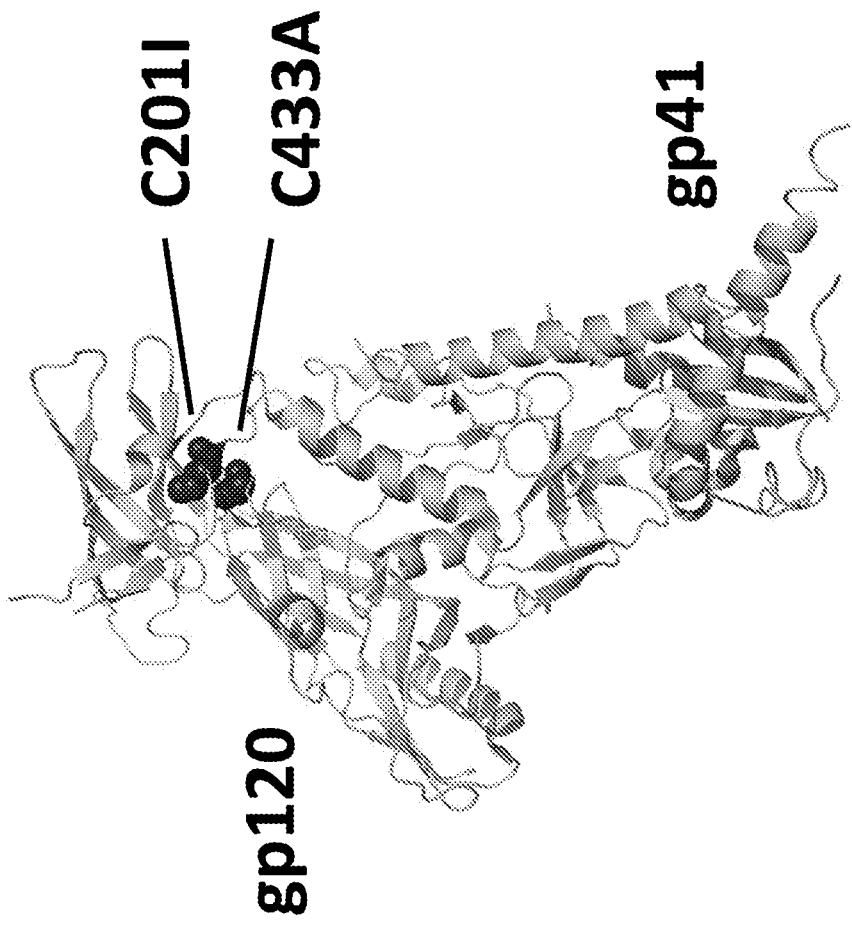
FIG. 65 shows CH505 TF SOSIP.II—removal of the DS mutations to improve CD4bs Ab binding. To test whether the DS stabilizing mutations disrupted CH103 UCA binding, since they were reported to decrease CD4 binding, the cysteine mutations were reverted back to the alanine and isoleucine present in the wildtype virus. The antigenicity of these trimers, called SOSIP.II, was tested.
Figure 66:
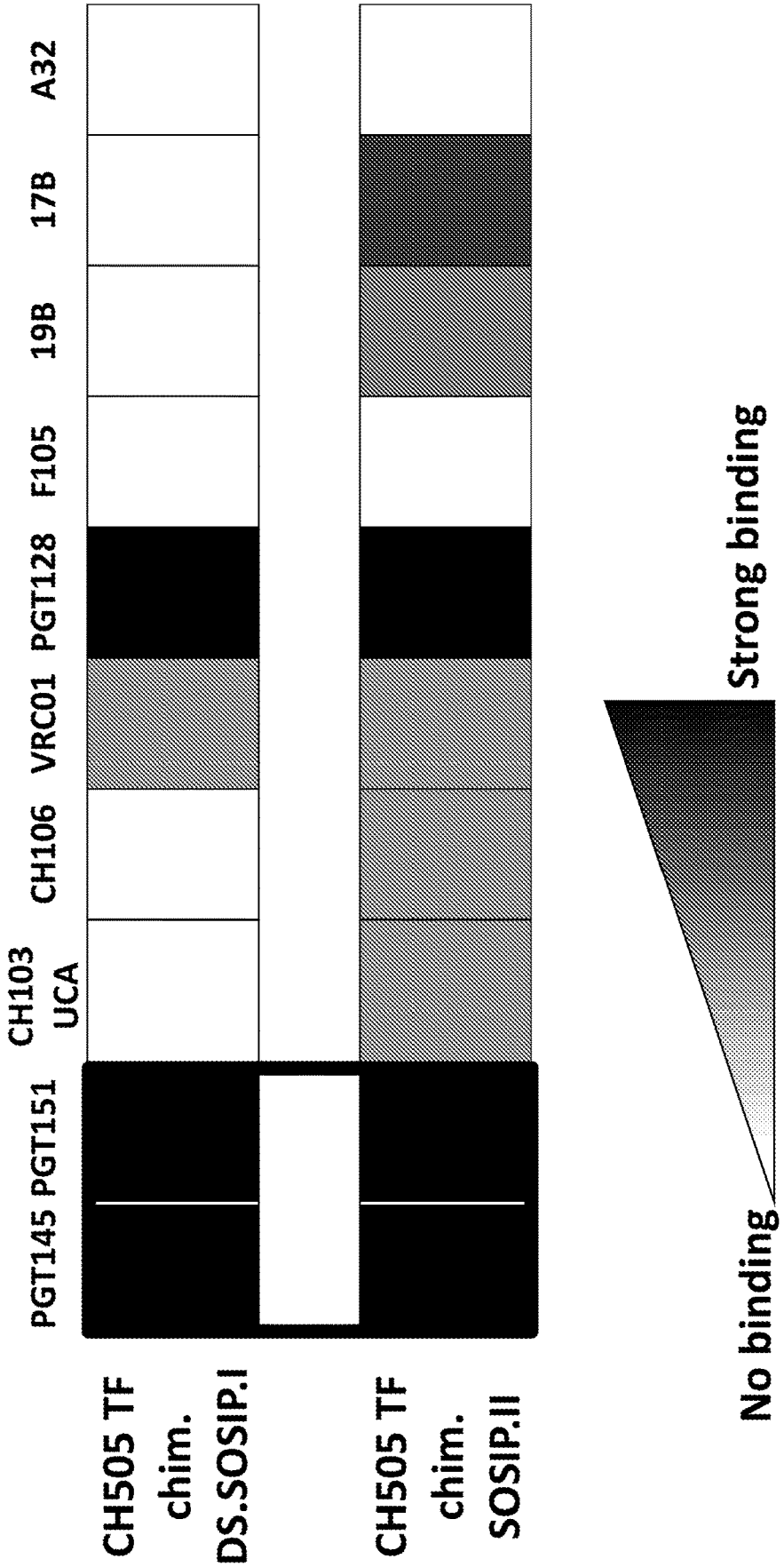
FIG. 66 shows removal of the disulfide stabilizing bond improves UCA binding. A summary of the binding of first SOSIP design called SOSIP.I for comparison to the SOSIP.II proteins is shown. The binding is heat mapped where the darker the color the stronger the binding in BLI experiments. Identical to the first SOSIP design, PGT151 and PGT145 bound to the SOSIP.II design relatively strongly indicating trimer formation. The CH103 lineage antibodies were also able to in bind the SOSIP.II version of the chimeric CH505 trimer. This design still had the V3 loop exposed and at least a portion of the trimers were in a CD4 bound conformation as indicated by 19B and 17B binding.
Figure 66:
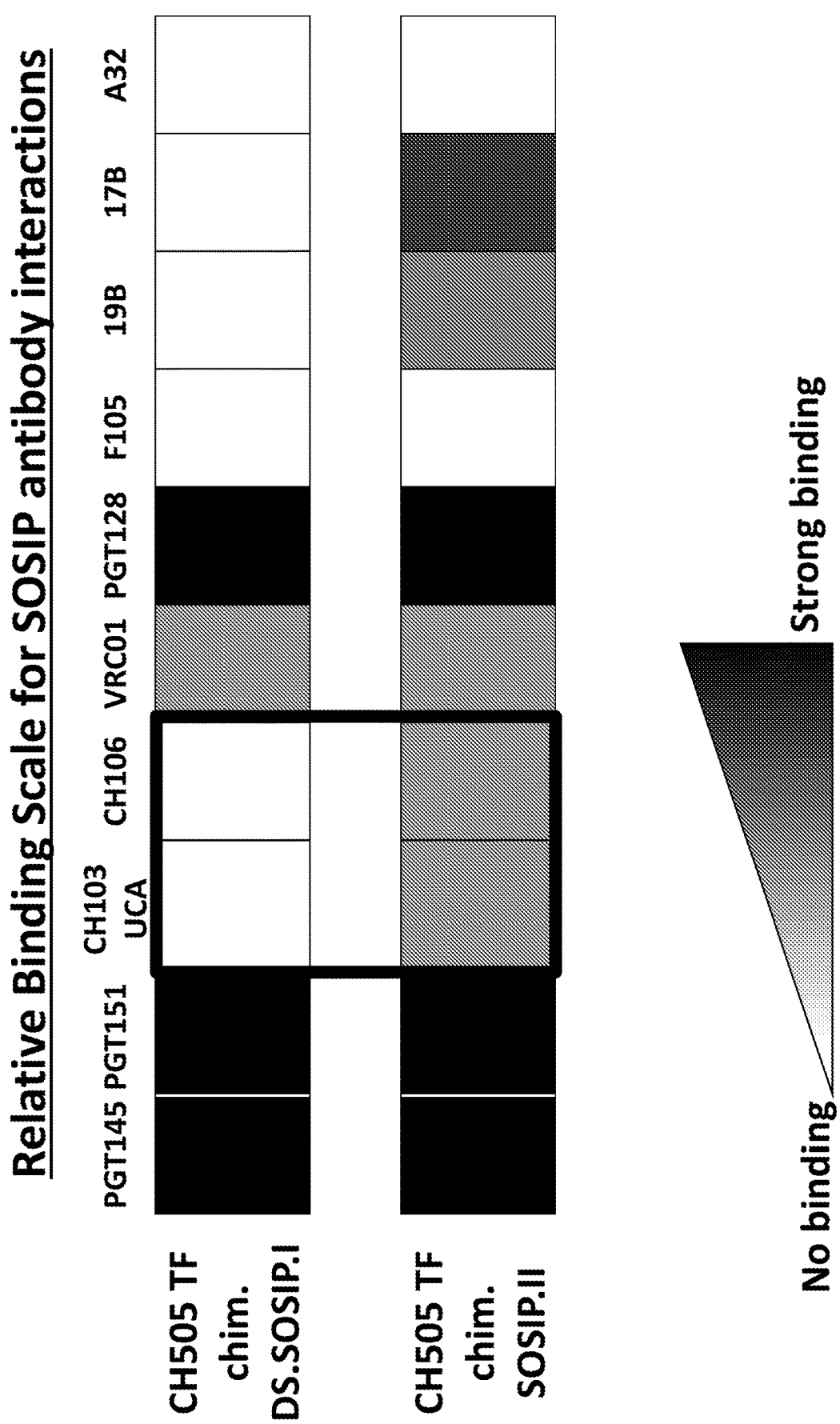
Figure 66:
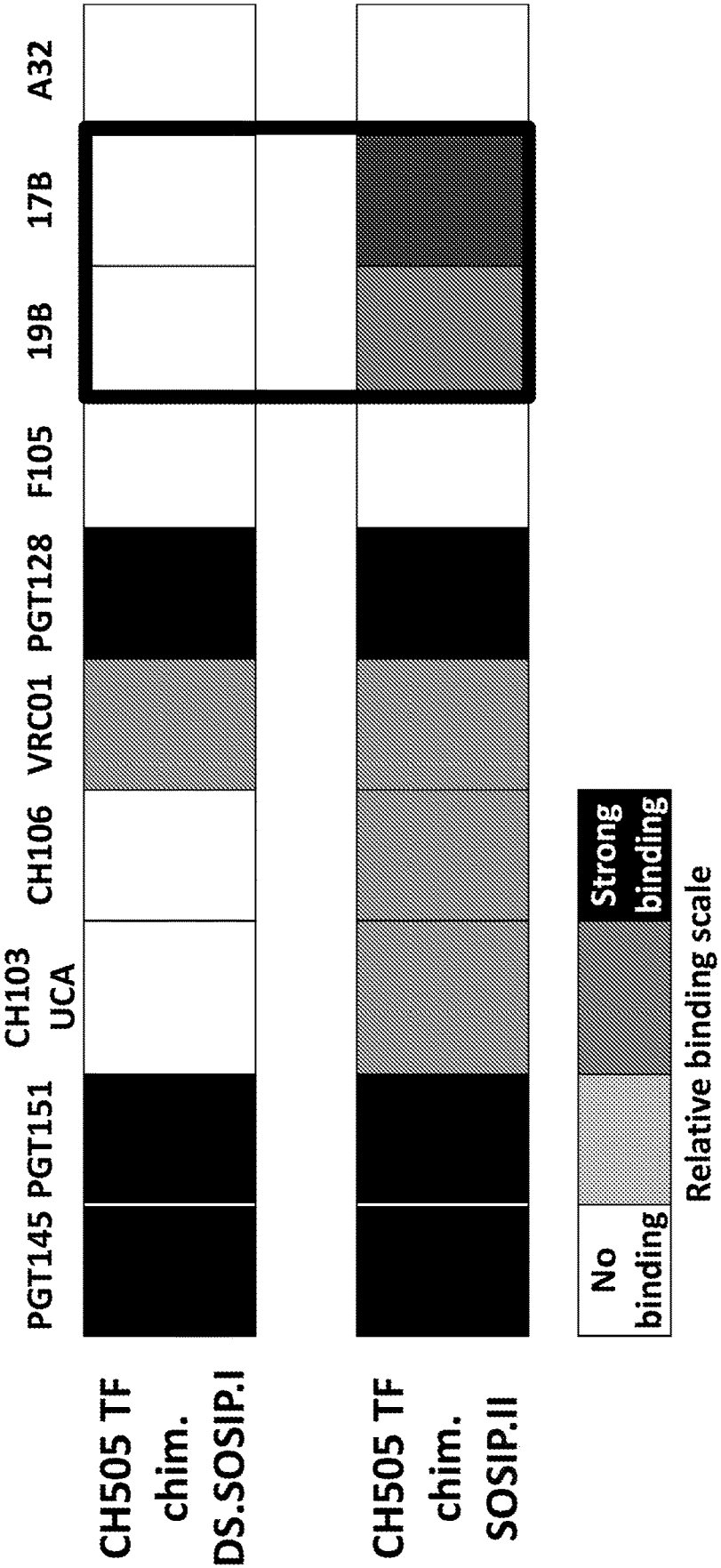
Figure 67:
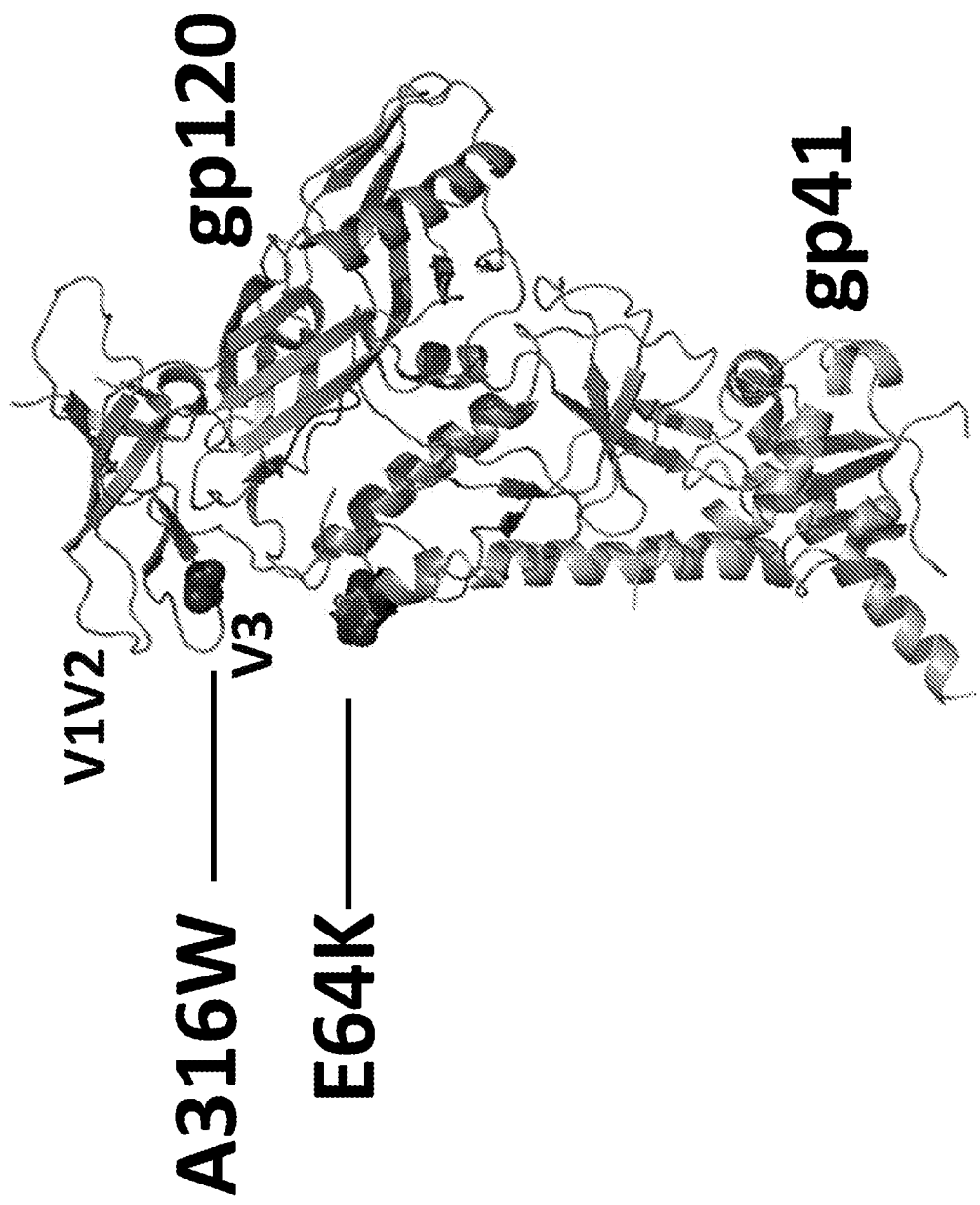
FIG. 67 shows CH505 TF chimeric SOSIP.III—introduction of two stabilizing mutation to reduce V3 exposure. Two mutations that reduced V3 exposure in nonchimeric SOSIPs were tested to see if these mutations could function similarly in the chimeric SOSIP design.
Figure 68:
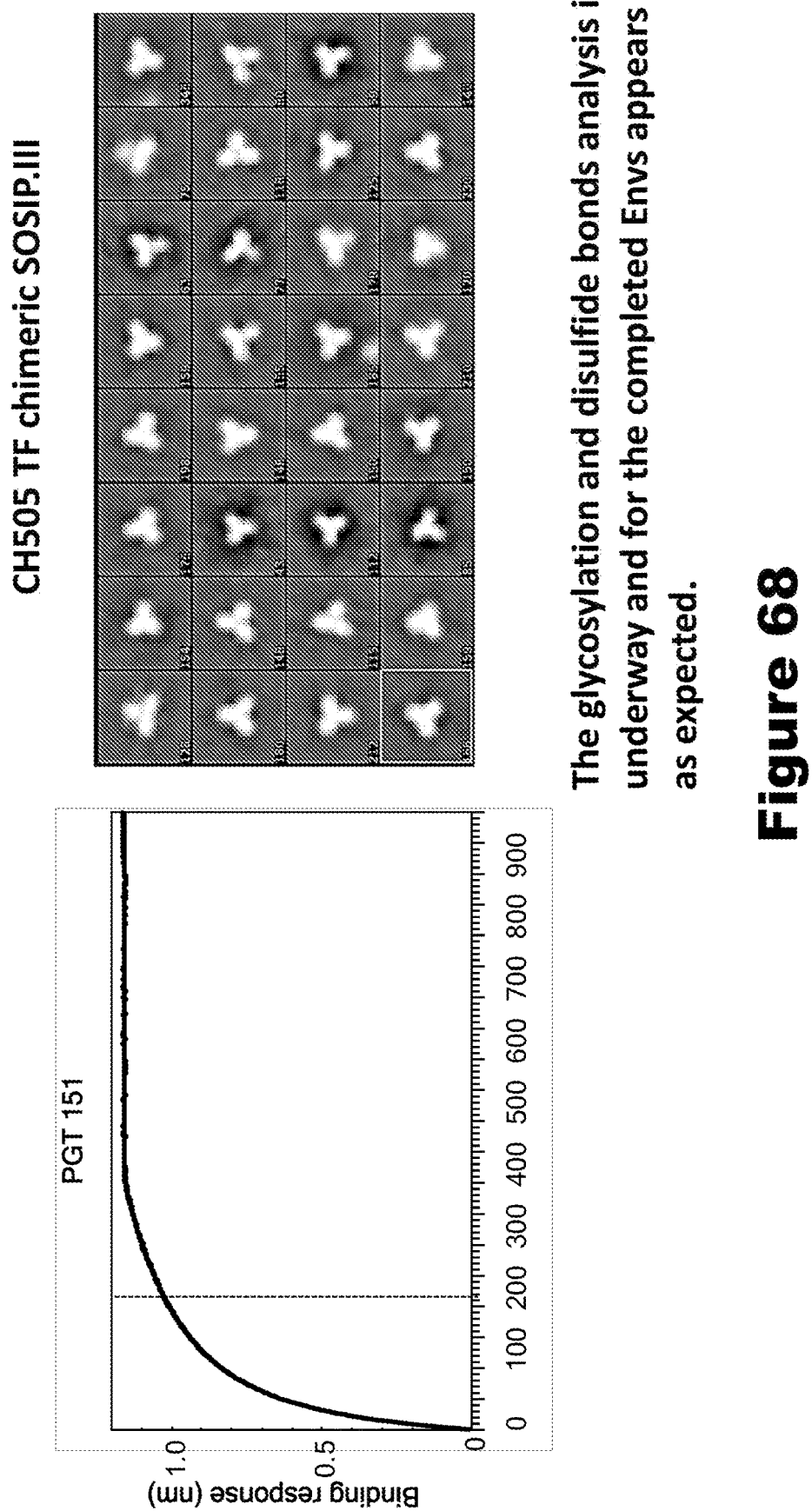
FIG. 68 shows CH505 TF chimeric SOSIP.III forms trimeric envelope and binds the CH103 UCA. The two mutations were introduced and the ability of this protein to form trimers was assessed by PGT151 binding and by negative stain EM. As shown on the left this protein bound to the trimer specific bnAb PGT151, and the protein formed a trimer as shown in the negative stain EM on the right.
Figure 69:
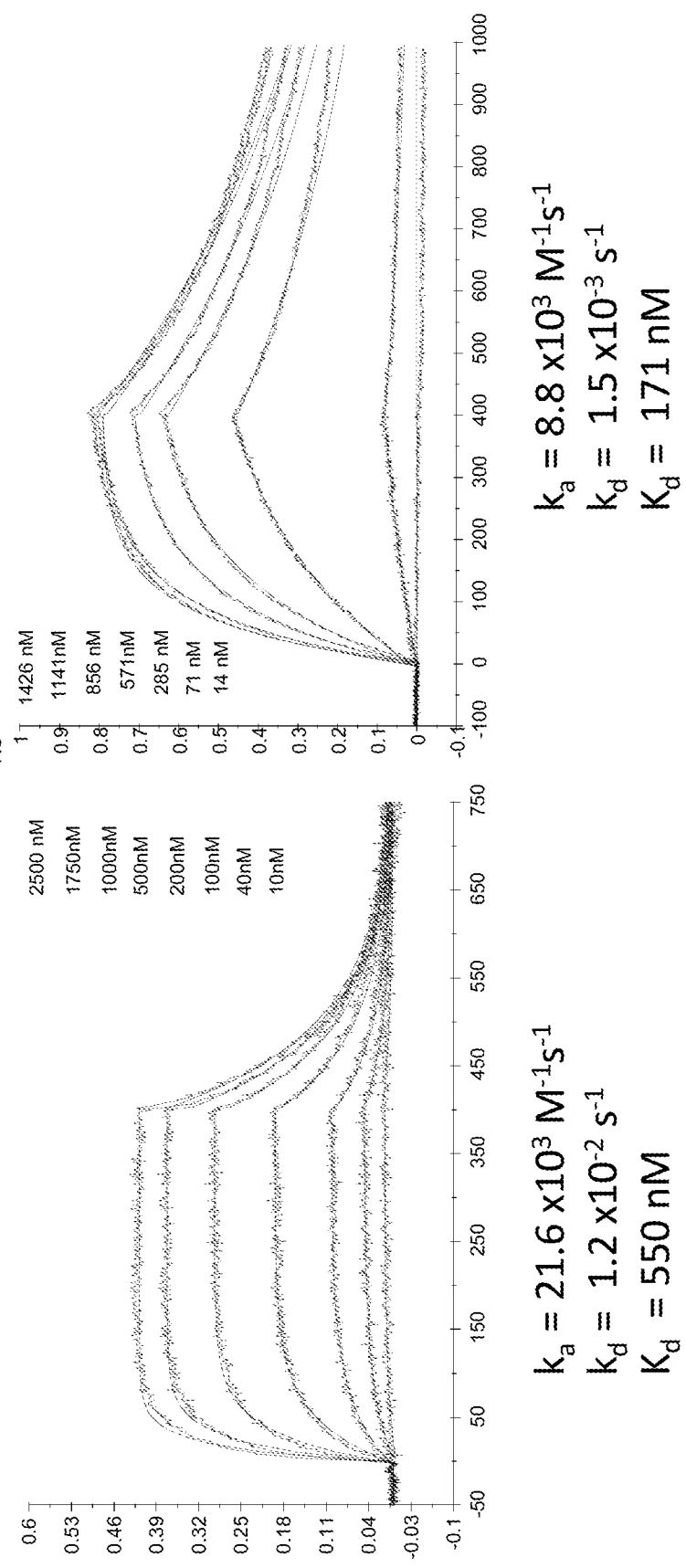
FIG. 69 shows CH103 UCA binds to the CH505 TF SOSIP.III. When binding of the SOSIP.III was assessed and compared to the CH505 TF gp120, it was observed that the off-rate for the CH103 UCA was 10-fold better for the trimer which resulted in an approved affinity for the timer compared to the gp120.
Figure 70:
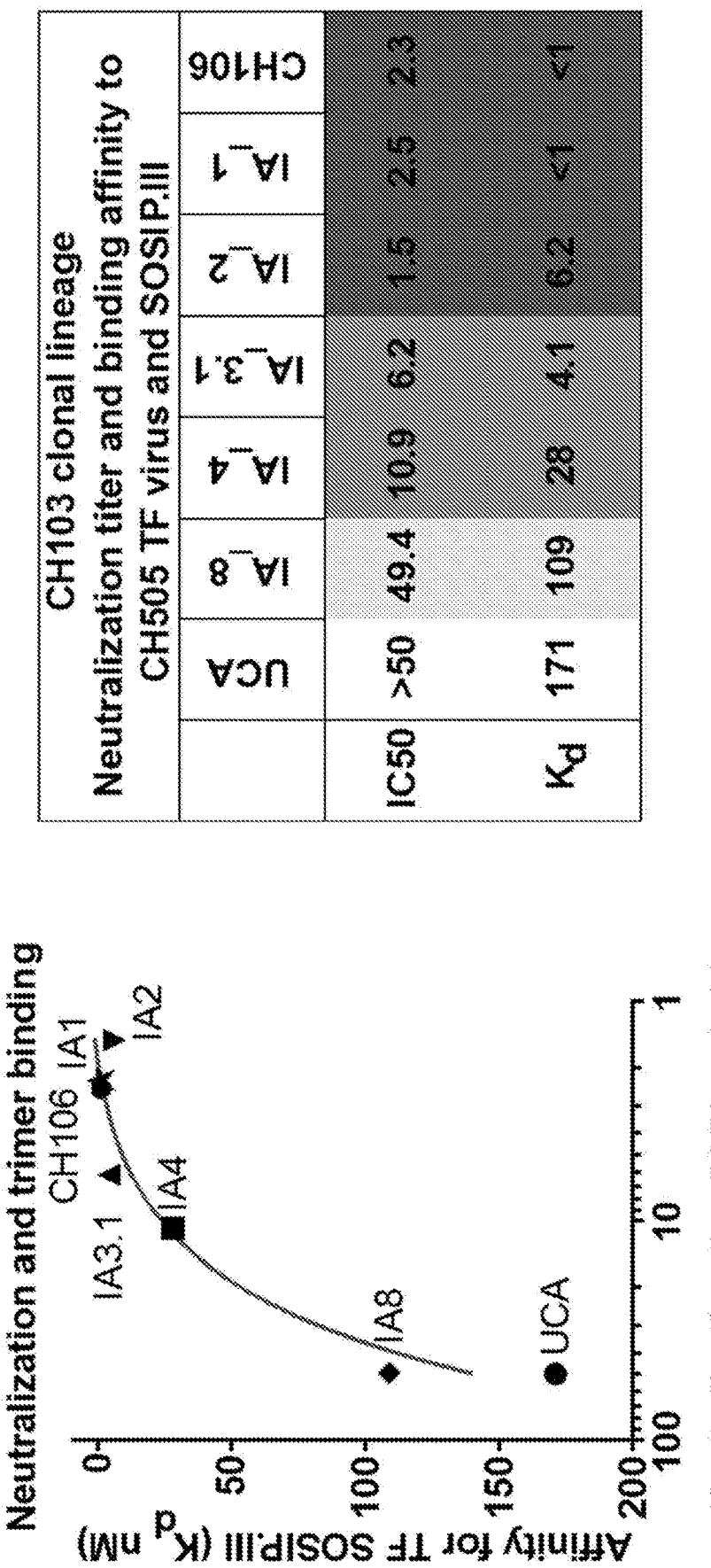
FIG. 70 shows affinity maturation to the TF SOSIPv4.1 correlates with neutralization potency. The binding of the members of the CH103 lineage to the CCH505 TF was assessed. A positive correlation between affinity for the CH505 TF SOSIP.III was found, shown here on the y-axis and bottom row of the table and neutralization potency against the CH505 TF virus shown here on the x-axis and in the table. As antibodies affinity matured and could bind more strongly to the CH505 TF trimer, they also were able to neutralize the CH505 virus more potently.
Figure 72:
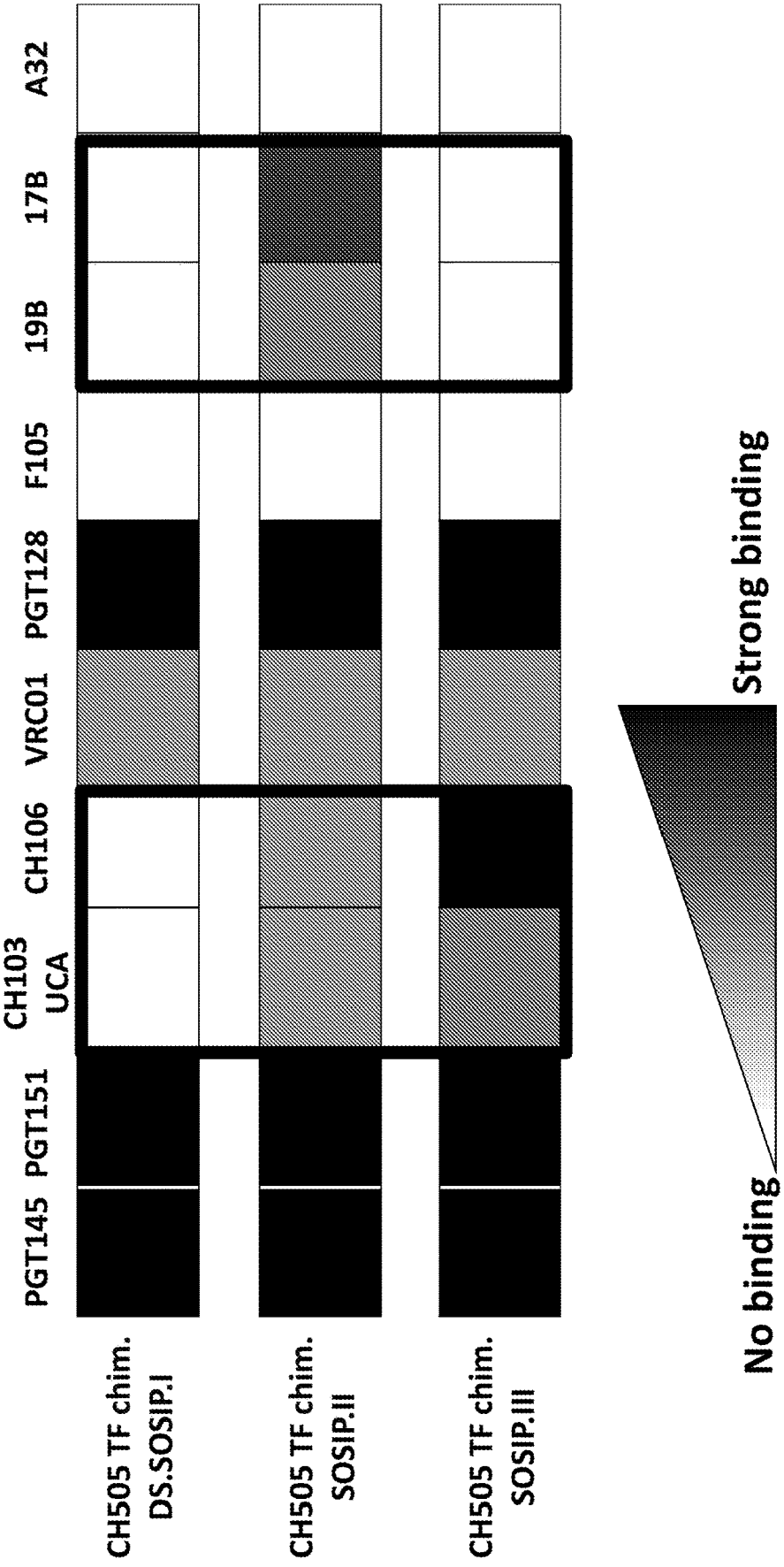
FIG. 72 shows rational design to improve the antigenicity of CH505 TF trimers. The SOSIP.III had the desired antigenicity for the CH103 lineage of antibodies. Its antigenicity on a larger panel of bnAbs was assessed. It bound to bnAbs but unlike the SOSIP.II it did not bind to 19B or 17B.
Figure 73:
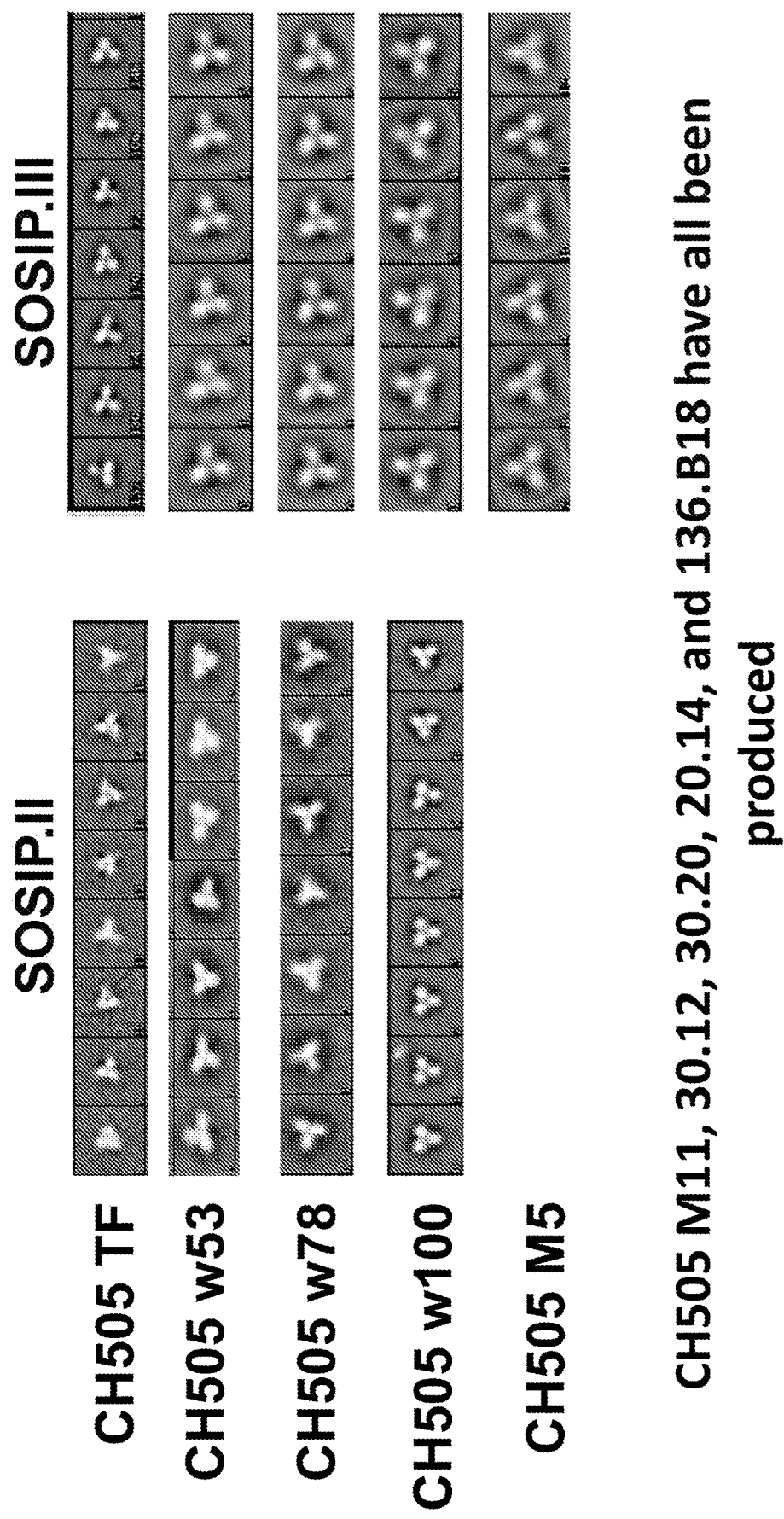
FIG. 73 shows CH505 Envs from sequential viruses form stable trimers as chimeric SOSIP.II and III.

It remains to be determined if multimerization of Env immunogens will be required for optimal immunogenicity. Multimerization strategies are more complicated and purification of trimer multimers will require considerable pre-production work. We have developed methods for expressing and purifying the CH505 M5 G458Y Env. FIG. 60A shows a model of the hexamer of M5 SOSIP trimers expressed on a ferritin scaffold. FIG. 60B shows purified CH505 M5 trimers after analysis in negative-stained EMs with class averages of the hexamer in multiple orientations. Purification plans for a trimer multimer have initiated. In the pre-production studies we will first develop two CH505 M5 G458Y research cell banks in the DG44 cell line, one expressing trimers, and one expressing hexamers. The process described above for trimers will be the starting point for purification of CH505 M G458Y trimers. The choice of which Env to move forward (trimer vs. hexamer of trimers) will be based on ongoing immunogenicity studies in CH235 UCA knock-in mice, rabbits or macaques.

Any of the immunogens of the invention could be tested for Ca2+ flux in a suitable cell line comprising a desired antibody, e.g. but not limited to CH235UCA2.

Animal Studies

The immunogens of the invention could be studied in various animal models. In some embodiments, the immunogenicity will be studied in an animal model comprising CH235UCA VH and/or VL chains knocked into an animal, e.g. a mouse. Any suitable animal could be used including rabbits, mice, and non-human primates.

In one example, CH235UCA knock in mice are immunized as follows:

Group 1: CH505 M5 SOSIPsG458Y grown in GnTI−/− cells (×4)×5 mice

Group 2: M5 gp120delta8 (×4)×4 mice

Adjuvant for both groups is GLA-SE. The immunogenicity in these animals will be analyzed by any suitable assay including neutralization, ELISA, etc.

Animal studies wherein the immunogens of the invention are administered as mRNA, for example but not limited as modified mRNAs formulated in LNPs, or self-replicating mRNAs formulated in LNPs.

Additional Sequences

Table 29 shows a summary of the sequence Evolution of CH235 Lineage: SHM, Timing, and Conformity of CH235-Lineage Development from UCA to Antibody with 90% Breadth. $V_H$-gene mutability accounts for the majority of positional conformity of CH235 lineage. (SEQ ID NOS 314-323, respectively). SEQ ID NOS 314-323 are included in the Sequence Listing which is submitted electronically herewith in ASCII format and is hereby incorporated by reference in its entirety and forms part of the specification. See also FIG. 43C of U.S. Provisional Application No. 62/511,226 filed May 25, 2017 and U.S. Provisional Application No. 62/565,952 filed Sep. 29, 2017.

TABLE 29

| Name | SEQ ID NO |
|---|---|
| IGHV1-46*01 | 314 |
| CH235 | 315 |
| CH235.9 | 316 |
| CH235.12 | 317 |
| 1B2530 | 318 |
| 8ANC131 | 319 |
| IGHV1-2*02 | 320 |

TABLE 29-continued

| Name | SEQ ID NO |
| --- | --- |
| VRC01 | 321 |
| VRC-CH31 | 322 |
| VRC-PG04 | 323 |

Figure 48:
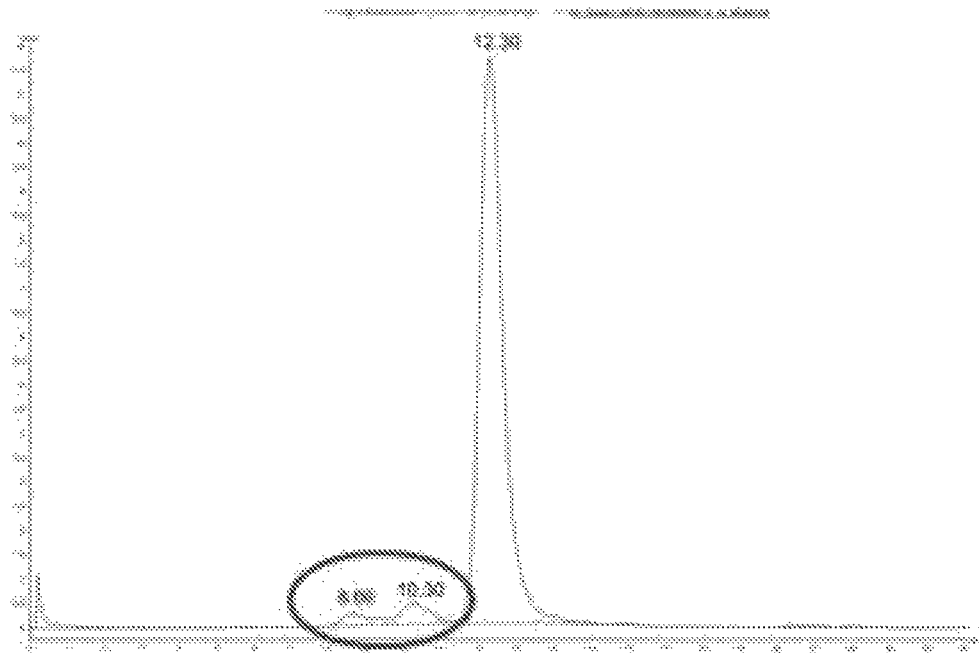
FIG. 48 shows the profile of intermediate antibody DH235VH_I1_v2_4A/293i, lot 218SJA without SEC purification.
Figure 49:
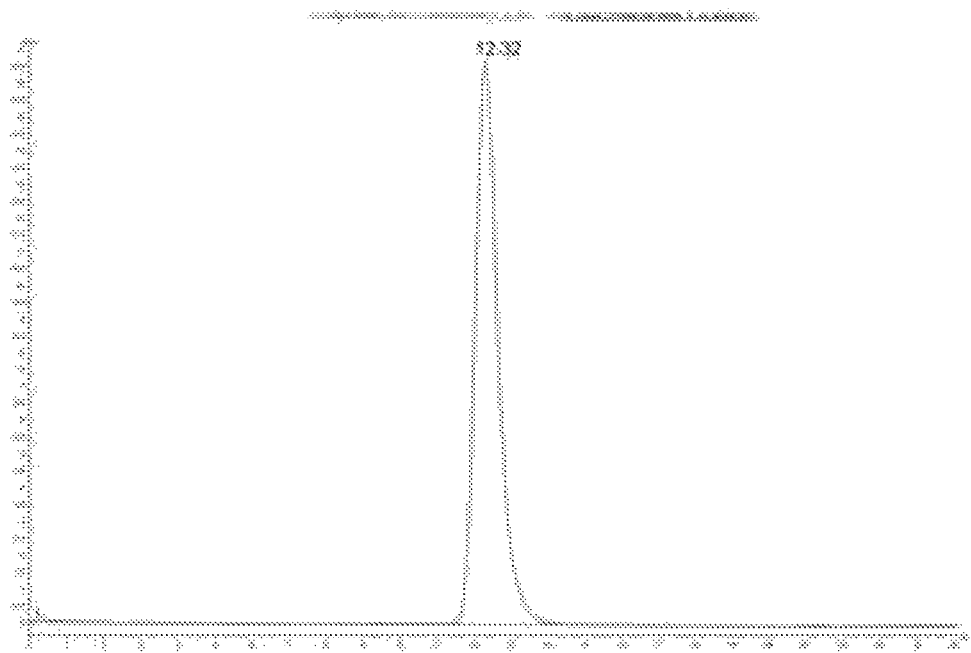
FIG. 49 shows the profile of intermediate antibody DH235_I1_v2_4A/293i, Lot 171017PPF after SEC purification.

Table 30 shows a summary of CH235 Lineage: Sequences and Neutralization Fingerprint Dendrogram. Sequences (SEQ ID NOS 324-385, respectively) and antibodies isolated from 17 time points from 6 to 323 weeks post-transmission and comparison of mutation patterns to other IGHV1-46 (1B2530 and 8ANC131) and IGHV1-2 (VRC01, VRC-CH31 and VRC-PG04) derived broadly neutralizing antibodies. IGHV1-46*01 is used as reference for IGHV1-46 derived antibodies and IGHV1-2*02 is used as reference for the three VRC01-class antibodies. SEQ ID NOS 324-385 are included in the Sequence Listing which is submitted electronically herewith in ASCII format and is hereby incorporated by reference in its entirety and forms part of the specification. See also FIG. 48A of U.S. Provisional Application No. 62/511,226 filed May 25, 2017 and U.S. Provisional Application No. 62/565,952 filed Sep. 29, 2017.

TABLE 30

| Name | SEQ ID NO |
| --- | --- |
| IGHV1-46*01 | 324 |
| UCA | 325 |
| 122w14 | 326 |
| 39w20 | 327 |
| 43w20 | 328 |
| 66w20 | 329 |
| 6w20 | 330 |
| 3w20 | 331 |
| 35w22 | 332 |
| 18w22 | 333 |
| 64w22 | 334 |
| 16w22 | 335 |
| 30w22 | 336 |
| 15w22 | 337 |
| 13w22 | 338 |
| 65w22 | 339 |
| 20w22 | 340 |
| 10w22 | 341 |
| 48w22 | 342 |
| 82w22 | 343 |
| 14w22 | 344 |
| 31w22 | 345 |
| 11w22 | 346 |
| 2w22 | 347 |
| 118w30 | 348 |
| 117w30 | 349 |
| 132w30 | 350 |
| 100w41 | 351 |
| 90w41 | 352 |
| 74w41 | 353 |
| 70w41 | 354 |
| 47w41 | 355 |
| 4w41 | 356 |
| 7w41 | 357 |
| 63w41 | 358 |
| 99w41 | 359 |
| 80w41 | 360 |
| 67w41 | 361 |
| CH235 | 362 |
| CH236 | 363 |
| CH239 | 364 |
| CH240 | 365 |
| CH241 | 366 |
| 28w53 | 367 |
| 24w53 | 368 |
| 1w53 | 369 |
| 124w66 | 370 |

TABLE 30-continued

| Name | SEQ ID NO |
| --- | --- |
| 49w66 | 371 |
| CH235.6 | 372 |
| CH235.7 | 373 |
| CH235.8 | 374 |
| CH235.9 | 375 |
| CH235.10 | 376 |
| CH235.11 | 377 |
| CH235.12 | 378 |
| CH235.13 | 379 |
| 1B2530 | 380 |
| 8ANC131 | 381 |
| IGHV1-2*02 | 382 |
| VRC01 | 383 |
| VRC-CH31 | 384 |
| VRC-PG04 | 385 |

Figure 50:
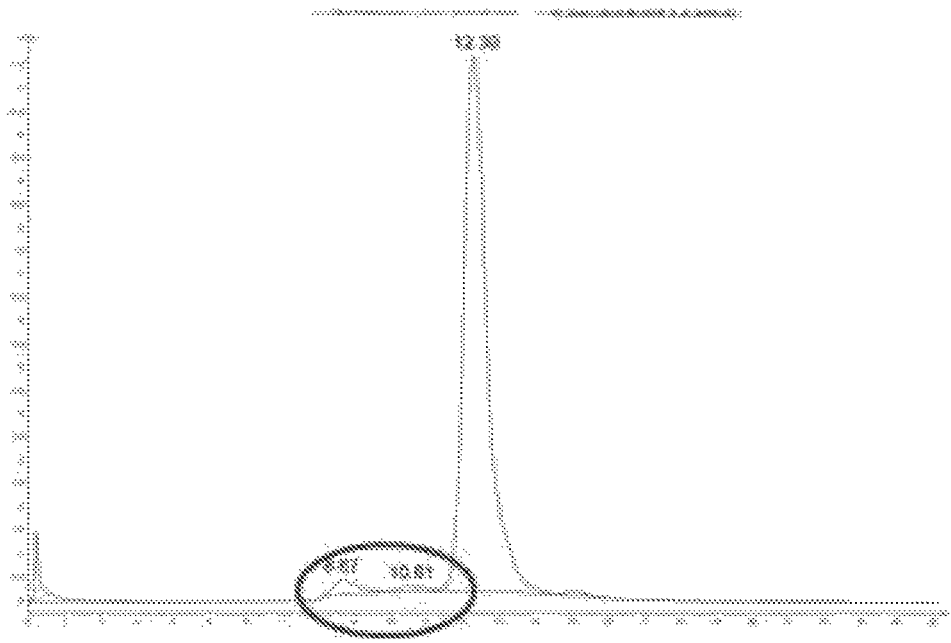
FIG. 50 shows the profile of intermediate antibody DH235_I3_v2_4A/293i, lot 330JAH without SEC purification.
Figure 51:
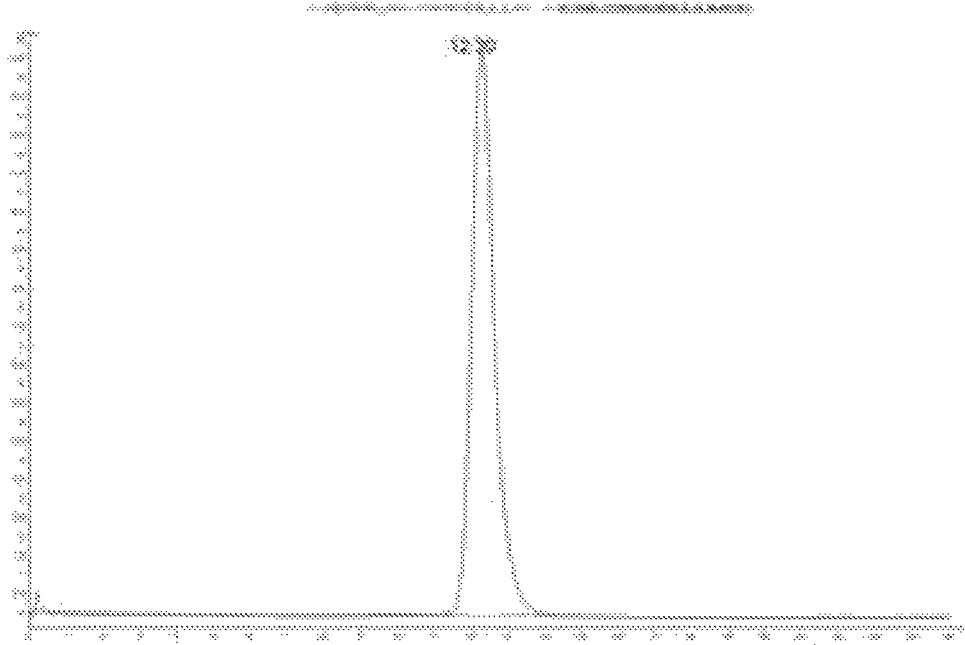
FIG. 51 shows the profile if intermediate antibody DH235_I3_v2_4A/293i, Lot 171013PPF after SEC purification.
Figure 52:
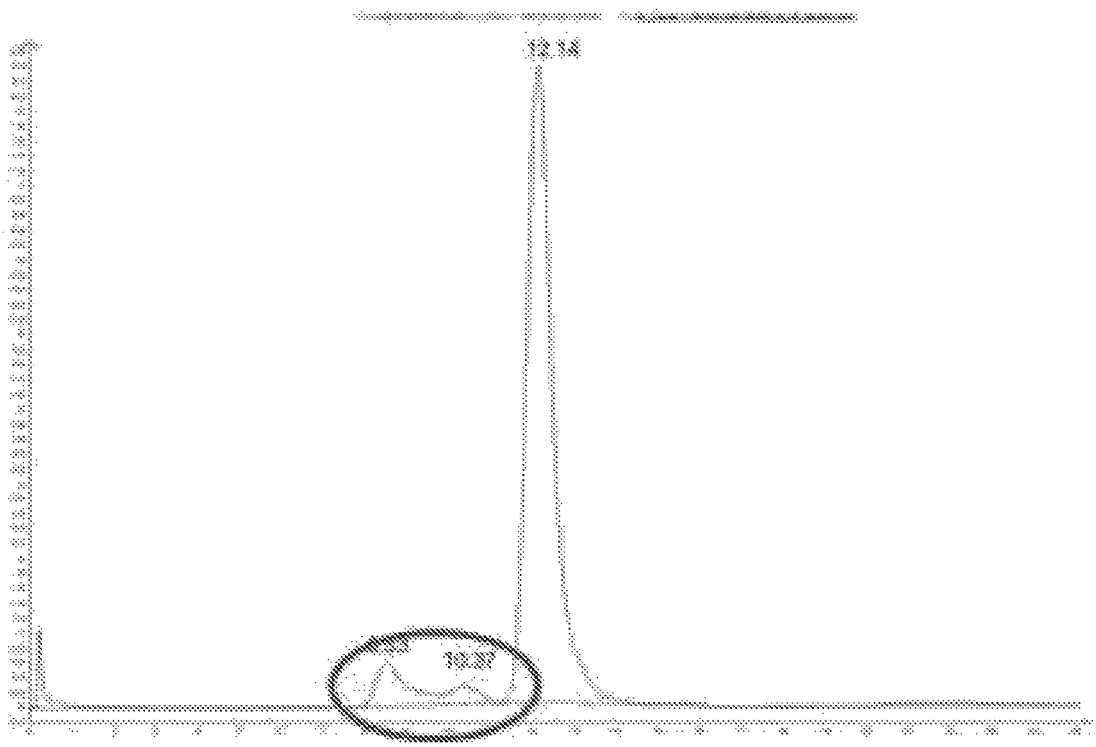
FIG. 52 shows the profile of intermediate antibody DH235_I4_v2_4A/293i, lot 4RKK without SEC purification.
Figure 53:
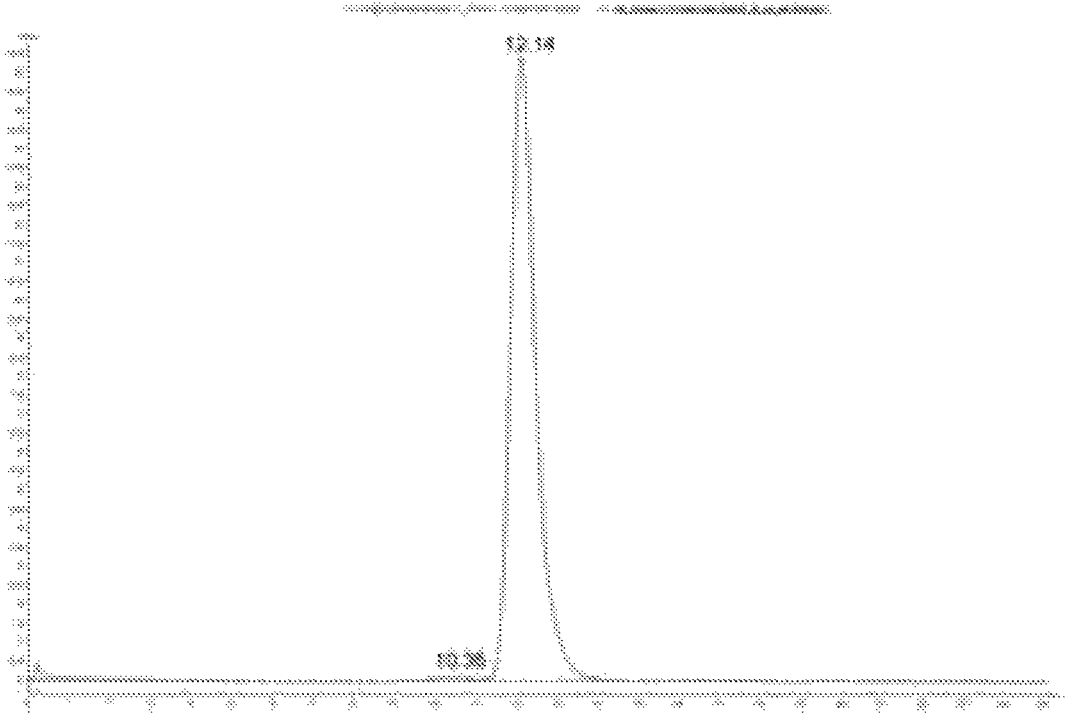
FIG. 53 shows the profile of intermediate antibody DH235_I4_v2_4A/293i, Lot 171018PPF after SEC purification.

Table 31 shows a summary of sequence Similarity Between VH1-2 and VH1-46 Broadly Neutralizing Antibodies and Mutability of Germline Genes. Amino acid alignment of 8ANC131 (SEQ ID NO: 387) and CH235 (SEQ ID NO: 388) to the IGHV1-46 (SEQ ID NO: 386) germline gene was performed. SEQ ID NOS 386-388 are included in the Sequence Listing which is submitted electronically herewith in ASCII format and is hereby incorporated by reference in its entirety and forms part of the specification. See also FIG. 50A of U.S. Provisional Application No. 62/511,226 filed May 25, 2017 and U.S. Provisional Application No. 62/565,952 filed Sep. 29, 2017.

TABLE 31

| Name | SEQ ID NO |
| --- | --- |
| IGHV1-46 | 386 |
| 8ANC131 | 387 |
| CH235 | 388 |

Table 32 shows a summary of sequence probability distribution of the number of sharing mutation positions for each pair of antibodies (SEQ ID NOS 389-395, respectively, in order of appearance). SEQ ID NOS 389-395 are included in the Sequence Listing which is submitted electronically herewith in ASCII format and is hereby incorporated by reference in its entirety and forms part of the specification. See also FIG. 50B of U.S. Provisional Application No. 62/511,226 filed May 25, 2017 and U.S. Provisional Application No. 62/565,952 filed Sep. 29, 2017.

TABLE 32

| Name | SEQ ID NO |
| --- | --- |
| Probability distribution of sharing mutation positions | 389 |
| Probability distribution of sharing mutation positions | 390 |
| Probability distribution of sharing mutation positions | 391 |
| Probability distribution of sharing mutation positions | 392 |
| Probability distribution of sharing mutation positions | 393 |
| Probability distribution of sharing mutation positions | 394 |
| Probability distribution of sharing mutation positions | 395 |

Table 33 shows primers designed with the online Agilent Quikchange primer designer tool (www.thermofisher.com) (SEQ ID NOS 8-15, respectively, in order of appearance).

TABLE 33

| Name | Sequence | SEQ ID NO |
|---|---|---|
| CH235.9$_{N30T}$ | CGTGGCGTCTGGATACAACTTCACCGAC TACTATATAC | 8 |
| CH235.9$_{D31T}$ | CGTCTGGATACAACTTCAACACCTACTA TATACACTGGGTGC | 9 |
| CH235.9$_{G62Q}$ | GGTCGCACAGATTACGCACAGGCGTTTG GGGA | 10 |
| CH235.9$_{G65Q}$ | GATTACGCAGGGGCGTTTCAGGACAGAG TGTCCA | 11 |
| CH235.9$_{A103E}$ | GTTAGAAATGTGGGAACGGAGGGCAGCT TGCTCCACTATG | 12 |
| CH235.9$_{G62Q/G65Q}$ | GGTCGCACAGATTACGCACAGGCGTTTC AGGACAGAGTGTCCA | 13 |
| CH235.9$_{S54R}$ | GGATCGACCCTAGGGGTGGTCGCACAG | 14 |
| CH235.9$_{A61S}$ | GTGGTCGCACAGATTACTCAGGGGCGTTTG | 15 |

Table 34 shows designed PCR primers. PCR amplifications performed with a common 5' primer II A (Clontech) and an Ig gene specific 3' primer (SEQ ID NO: 16) using KAPA HIFI qPCR kit (Kapa Biosystems). PCR amplification performed with primers with 454 sequencing adapters (454-RACE-F: 5'CCATCTCATCCCTGCGTGTCTCCGACTCAGAAGC AGTGGTATCAACGCAGAGT3' (SEQ ID NO: 17); 454-IgG-R:

5'CCTATCCCCTGTGTGCCTTGGCAGTCTCAGGGGGAAGACCGATGGGC

CCTTGGTGG3' (SEQ ID NO: 18)).

TABLE 34

| Sequence | SEQ ID NO |
|---|---|
| 5'GGGGAAGACCGATGGGCCCTTGGTGG3' | 16 |
| 5'CCATCTCATCCCTGCGTGTCTCCGACTCAGAAGCAGTGG TATCAACGCAGAGT3' | 17 |
| 5'CCTATCCCCTGTGTGCCTTGGCAGTCTCAGGGGAAGAC CGATGGGCCCTTGGTGG3' | 18 |

SEQUENCE LISTING (477 sequences)

SEQ ID NO: 1 - protein, 4 aa, Human immunodeficiency virus
REKR

SEQ ID NO: 2 - protein, 9 aa, Human immunodeficiency virus
RRVVEREKR

SEQ ID NO: 3 - protein, 9 aa, Artificial Sequence
  Description of Artificial Sequence: Synthetic peptide
ERVVEREKE

SEQ ID NO: 4 - protein, 4 aa, Artificial Sequence
  Description of Artificial Sequence: Synthetic peptide
SEKS

SEQ ID NO: 5 - protein, 79 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQE

SEQ ID NO: 6 - protein, 33 aa, Artificial Sequence
  Description of Artificial Sequence: Synthetic polypeptide
TRPNNNTRKSIRIGPGQTFYATGDIIGNIRQAH

SEQ ID NO: 7 - protein, 24 aa, Homo sapiens
MPMGSLQPLATLYLLGMLVASVLA

SEQ ID NO: 8 - DNA, 38 bp, Artificial Sequence
  Description of Artificial Sequence: Synthetic primer
cgtggcgtctggatacaacttcaccgactactatatac

SEQ ID NO: 9 - DNA, 42 bp, Artificial Sequence
  Description of Artificial Sequence: Synthetic primer
cgtctggatacaacttcaacacctactatatacactgggtgc

SEQ ID NO: 10 - DNA, 32 bp, Artificial Sequence
  Description of Artificial Sequence: Synthetic primer
ggtcgcacagattacgcacaggcgtttgggga

SEQ ID NO: 11 - DNA, 34 bp, Artificial Sequence
  Description of Artificial Sequence: Synthetic primer
gattacgcaggggcgtttcaggacagagtgtcca

SEQ ID NO: 12 - DNA, 40 bp, Artificial Sequence
  Description of Artificial Sequence: Synthetic primer
gttagaaatgtgggaacggagggcagcttgctccactatg

SEQ ID NO: 13 - DNA, 43 bp, Artificial Sequence
  Description of Artificial Sequence: Synthetic primer
ggtcgcacagattacgcacaggcgtttcaggacagagtgtcca

SEQ ID NO: 14 - DNA, 27 bp, Artificial Sequence
  Description of Artificial Sequence: Synthetic primer
ggatcgaccctaggggtggtcgcacag

SEQ ID NO: 15 - DNA, 30 bp, Artificial Sequence
  Description of Artificial Sequence: Synthetic primer
gtggtcgcacagattactcaggggcgtttg

SEQ ID NO: 16 - DNA, 26 bp, Artificial Sequence
  Description of Artificial Sequence: Synthetic primer
ggggaagaccgatgggcccttggtgg

SEQ ID NO: 17 - DNA, 53 bp, Artificial Sequence
  Description of Artificial Sequence: Synthetic primer
ccatctcatccctgcgtgtctccgactcagaagcagtggtatcaacgcagagt

SEQ ID NO: 18 - DNA, 56 bp, Artificial Sequence
  Description of Artificial Sequence: Synthetic primer
cctatcccctgtgtgccttggcagtctcagggggaagaccgatgggcccttggtgg

SEQ ID NO: 19 - DNA, 32 bp, Artificial Sequence
  Description of Artificial Sequence: Synthetic oligonucleotide
tgatgaggtgaccgaattcgggacccggatcc

SEQ ID NO: 20 - DNA, 32 bp, Artificial Sequence
  Description of Artificial Sequence: Synthetic oligonucleotide
tgatgaggtgaccgaattcaggtcccggatcc

SEQ ID NO: 21 - DNA, 32 bp, Artificial Sequence
  Description of Artificial Sequence: Synthetic oligonucleotide
tgatgagggacccgaattcggtcaccggatcc

SEQ ID NO: 22 - DNA, 32 bp, Artificial Sequence
  Description of Artificial Sequence: Synthetic oligonucleotide
tgatgagggtcctgaattcggttaccggatcc

SEQ ID NO: 23 - DNA, 32 bp, Artificial Sequence
  Description of Artificial Sequence: Synthetic oligonucleotide
tgatgagaattcggtcaccgggtcctggatcc

SEQ ID NO: 24 - DNA, 32 bp, Artificial Sequence
  Description of Artificial Sequence: Synthetic oligonucleotide
tgatgagaattcggtgaccgggacctggatcc

SEQ ID NO: 25 - DNA, 2131 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaagaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtgaccgaattcgggacccggatcc

SEQ ID NO: 26 - DNA, 2131 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtgaccgaattcaggtcccggatcc

SEQ ID NO: 27 - DNA, 2131 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaacaactccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacgtccatccggatcggccctggccaggccttctacgccaccggccaggtgatcggcgacatccgcaaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagggacccgaattcggtcaccggatcc

SEQ ID NO: 28 - DNA, 2131 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagatgaccccgctgtgcgtgaccctgaactgcaccaacgccaccgcgatcaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgacaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagagctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagggtcctgaattcggttaccggatcc

SEQ ID NO: 29 - DNA, 2140 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgagctgcacgaacgccaccaacgcgacggcgtcgaactcgtccatcctcgaggggatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctccgagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacctccaccgacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacgacacggacaccttcaggccagagggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagctgatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggtcaccgggtcctggatcc

SEQ ID NO: 30 - DNA, 2143 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccgacgccaccgcgtccaacgcaaccgcgagcaacgccacggcgtcgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgtcgaacaacacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaacaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcggggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatgatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggtgaccgggacctggatcc

SEQ ID NO: 31 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 32 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 33 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNNSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 34 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKMTPLCVTLNCTNATAINSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPNNKTRTSIRIGPGQAFYATGQVIGDIREAHCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKSYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 35 - protein, 698 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRIITIRCRIKQIINMWQEVGRAMYAPPIAGNITCISNITGLLLTRDGGNNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIGAQQHMLKLTVWGIKQLQARVLALERYLKDQQLLGMWGCSGKLICTTNVYWNSSWSNKTYGDIWDNMTWMQWEREISNYTEMIYELLEESQNQQEKNEQDLLALDRWNSLWNWFNITNWLWYIKIFIMIVGGLIGLRIIFAVLSLVNRVRQG

SEQ ID NO: 36 - protein, 697 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLSCTNATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNDTDTFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWNWFNITNWLWYIKIFIMIVGGLIGLRIIFAVLSLVNRVRQG

SEQ ID NO: 37 - protein, 698 aa, Artificial Sequence; identical to SEQ ID NO: 35
  Description of Artificial Sequence: Synthetic polypeptide

SEQ ID NO: 38 - DNA, 32 bp, Artificial Sequence
  Description of Artificial Sequence: Synthetic oligonucleotide
tagtaaggtgaccgaattcgggacccggatcc

SEQ ID NO: 39 - DNA, 32 bp, Artificial Sequence
  Description of Artificial Sequence: Synthetic oligonucleotide
tagtaaggtgaccgaattcaggtcccggatcc

SEQ ID NO: 40 - DNA, 32 bp, Artificial Sequence
  Description of Artificial Sequence: Synthetic oligonucleotide
tagtaagggacccgaattcggtcaccggatcc

SEQ ID NO: 41 - DNA, 32 bp, Artificial Sequence
  Description of Artificial Sequence: Synthetic oligonucleotide
tagtaagggtcctgaattcggttaccggatcc

SEQ ID NO: 42 - DNA, 32 bp, Artificial Sequence
  Description of Artificial Sequence: Synthetic oligonucleotide
tagtaagaattcggtcaccgggtcctggatcc

SEQ ID NO: 43 - DNA, 32 bp, Artificial Sequence
  Description of Artificial Sequence: Synthetic oligonucleotide
tagtaagaattcggtgaccgggacctggatcc

SEQ ID NO: 44 - DNA, 1507 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaagaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtgaccgaattcgggacccggatcc

SEQ ID NO: 45 - DNA, 1507 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtgaccgaattcaggtcccggatcc

SEQ ID NO: 46 - DNA, 1507 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaacaactccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacgtccatccggatcggccctggccaggccttctacgccaccggccaggtgatcggcgacatccgcaaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagggacccgaattcggtcaccggatcc

SEQ ID NO: 47 - DNA, 1507 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagatgaccccgctgtgcgtgaccctgaactgcaccaacgccaccgcgatcaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgacaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagggtcctgaattcggttaccggatcc

SEQ ID NO: 48 - DNA, 1516 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgagctgcacgaacgccaccaacgcgacggcgtcgaactcgtccatcctcgaggggatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctccgagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacctccaccgacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacgacacggacaccttcaggccagagggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggtcaccgggtcctggatcc

SEQ ID NO: 49 - DNA, 1519 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccgacgccaccgcgtccaacgcaaccgcgagcaacgccacggcgtcgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgtcgaacaacacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaacaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggtgaccgggacctggatcc

SEQ ID NO: 50 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 51 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 52 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNNSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 53 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKMTPLCVTLNCTNATAINSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPNNKTRTSIRIGPGQAFYATGQVIGDIREAHCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 54 - protein, 489 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLSCTNATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNDTDTFRPEGGNMKDNWRSELYKYKVVEVKPLGVAPTNARERVVEREKE

SEQ ID NO: 55 - protein, 490 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRIITIRCRIKQIINMWQEVGRAMYAPPIAGNITCISNITGLLLTRDGGNNNTETFRPGGGNMKDNWRSELYKYKVVEVKPLGVAPTNARERVVEREKE

SEQ ID NO: 56 - DNA, 2581 bp, Artificial Sequence
  Description of Artificial Sequence: Synthetic polynucleotide
gtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaagaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggtgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaaggtgaccgaattcgggacccggatcc

SEQ ID NO: 57 - DNA, 2581 bp, Artificial Sequence
  Description of Artificial Sequence: Synthetic polynucleotide
gtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggtgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaaggtgaccgaattcaggtcccggatcc

SEQ ID NO: 58 - DNA, 2581 bp, Artificial Sequence
  Description of Artificial Sequence: Synthetic polynucleotide
gtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaacaactccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacgtccatccggatcggccctggccaggccttctacgccaccggccaggtgatcggcgacatccgcaaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggtgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaagggacccgaattcggtcaccggatcc

SEQ ID NO: 59 - DNA, 2581 bp, Artificial Sequence
  Description of Artificial Sequence: Synthetic polynucleotide
gtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagatgaccccgctgtgcgtgaccctgaactgcaccaacgccaccgcgatcaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgacaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagagctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggtgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaagggtcctgaattcggttaccggatcc

SEQ ID NO: 60 - DNA, 2590 bp, Artificial Sequence
  Description of Artificial Sequence: Synthetic polynucleotide
gtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgagctgcacgaacgccaccaacgcgacggcgtcgaactcgtccatcctcgaggggatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctccgagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacctccaccgacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacgacacggacaccttcaggccagagggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagctgatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggcgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggcaacctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaagaattcggtcaccgggtcctggatcc

SEQ ID NO: 61 - DNA, 2593 bp, Artificial Sequence
  Description of Artificial Sequence: Synthetic polynucleotide
gtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccgacgccaccgcgtccaacgcaaccgcgagcaacgccacggcgtcgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgtcgaacaacacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaacaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcggggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatgatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaagcgctccacgcgcctggtgtccggcttcctggccctggtgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgcgctgggcatctgccgcgccatccgcaacatccccacccgcatccgccagggcttcgagaccgccctcctgtagtaagaattcggtgaccgggacctggatcc

SEQ ID NO: 62 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 63 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 64 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNNSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 65 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKMTPLCVTLNCTNATAINSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPNNKTRTSIRIGPGQAFYATGQVIGDIREAHCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKSYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 66 - protein, 849 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLSCTNATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNDTDTFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGNLVQYWGLELKRSAISLLDTLAIAVGEGTDRILEFVLGICRAIRNIPTRIRQGFETALL

SEQ ID NO: 67 - protein, 850 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRIITIRCRIKQIINMWQEVGRAMYAPPIAGNITCISNITGLLLTRDGGNNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIGAQQHMLKLTVWGIKQLQARVLALERYLKDQQLLGMWGCSGKLICTTNVYWNSSWSNKTYGDIWDNMTWMQWEREISNYTEMIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRKRSTRLVSGFLALVWDDLRSLCLFIYHRLRDFILIAARAGELLGRSSLKGLRRGWEALKYLGSLVQYWGLELKRSAISLLDTLAIAVGEGTDRILEFALGICRAIRNIPTRIRQGFETALL

SEQ ID NO: 68 - DNA, 32 bp, Artificial Sequence; identical to SEQ ID NO: 19
  Description of Artificial Sequence: Synthetic oligonucleotide

SEQ ID NO: 69 - DNA, 32 bp, Artificial Sequence; identical to SEQ ID NO: 20
  Description of Artificial Sequence: Synthetic oligonucleotide

SEQ ID NO: 70 - DNA, 32 bp, Artificial Sequence; identical to SEQ ID NO: 21
  Description of Artificial Sequence: Synthetic oligonucleotide

SEQ ID NO: 71 - DNA, 32 bp, Artificial Sequence; identical to SEQ ID NO: 22
  Description of Artificial Sequence: Synthetic oligonucleotide

SEQ ID NO: 72 - DNA, 32 bp, Artificial Sequence; identical to SEQ ID NO: 23
  Description of Artificial Sequence: Synthetic oligonucleotide

SEQ ID NO: 73 - DNA, 32 bp, Artificial Sequence
  Description of Artificial Sequence: Synthetic oligonucleotide
tgatgagaattcggtgaccgggtcccggatcc

SEQ ID NO: 74 - DNA, 32 bp, Artificial Sequence
  Description of Artificial Sequence: Synthetic oligonucleotide
tgatgagggtcccgaattcggttaccggatcc

SEQ ID NO: 75 - DNA, 32 bp, Artificial Sequence
  Description of Artificial Sequence: Synthetic oligonucleotide
tgatgagaattcggtaaccaggtcccggatcc

SEQ ID NO: 76 - DNA, 32 bp, Artificial Sequence
  Description of Artificial Sequence: Synthetic oligonucleotide
tgatgaggtaaccgggacccgaattcggatcc

SEQ ID NO: 77 - DNA, 32 bp, Artificial Sequence; identical to SEQ ID NO: 24
  Description of Artificial Sequence: Synthetic oligonucleotide

SEQ ID NO: 78 - DNA, 2131 bp, Artificial Sequence; identical to SEQ ID NO: 25
  Description of Artificial Sequence: Synthetic polynucleotide

SEQ ID NO: 79 - DNA, 2131 bp, Artificial Sequence; identical to SEQ ID NO: 26
  Description of Artificial Sequence: Synthetic polynucleotide

SEQ ID NO: 80 - DNA, 2131 bp, Artificial Sequence; identical to SEQ ID NO: 27
  Description of Artificial Sequence: Synthetic polynucleotide

SEQ ID NO: 81 - DNA, 2131 bp, Artificial Sequence; identical to SEQ ID NO: 28
  Description of Artificial Sequence: Synthetic polynucleotide

SEQ ID NO: 82 - DNA, 2140 bp, Artificial Sequence; identical to SEQ ID NO: 29
  Description of Artificial Sequence: Synthetic polynucleotide

SEQ ID NO: 83 - DNA, 2186 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgaacgccaccgcgtccaactcctctatcatcgaggggatgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctcggagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacgtccaccgacatggccaactccaccgagaccaactccacgcgcatcatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcgagacgttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggtgaccgggtcccggatccagatctgctgtgcctt

SEQ ID NO: 84 - DNA, 2159 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgacgaacgccaccgcgtccaactcgtccatcatcgaggagatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacacggcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggcggcgagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagggtcccgaattcggttaccggatccagatctgctgtgcctt

SEQ ID NO: 85 - DNA, 2153 bp, Artificial Sequence
  Description of Artificial Sequence: Synthetic polynucleotide
gtcgacaagaagccaccatgcgcgtgacgggcatccagcgcaactacccgcagtggtggatctggtcgatgctgggcctctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcatcgacgccaacgcgaccgcgtccaacgcgacggcatccaactcgtccatcatcgaggggatgaagaactgctccttcaacatcacgacggagctgcgcgacaagatcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacgaacagcgcgaagaccatcatcgtgcacctgaacgagtccgtgaagatcgagtgcacccgcccgagcaacaacacgcgcacctccatccggatcggccctggccaggccttctacgccaccggccaggtgatcggcgacatccgcaaggcgcactgcaacatctccgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcacgatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacaacaccacggagaccttcaggccagggggaggcaacatgaaggacaactggcgctccgagctgtacaagtacaaggtggtggagatcaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccgactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggtaaccaggtcccggatccagatctgctgtgcctt

SEQ ID NO: 86 - DNA, 2198 bp, Artificial Sequence
  Description of Artificial Sequence: Synthetic polynucleotide
gtcgacaagaagccaccatgaaggtgcggggcatccagcgcaactacccgcagtggtggatctggtcgatgctgggcctctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctggagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcacggacgccaacgccaccgcgtcgaacaccaacgcgaccgcaagcaacatcaacgcgacggcgtcgaagtcctccatcatcgaggagatgaagaactgctccttcaacatcacgacggagctgcgcgacaagcgcgagaagaagtacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacagcaagaccatcatcgtgcacctgaacgagtccgtgaagatcgagtgcacccgcccgagcaacaacacgcgcacctccatccggatcggccctggccaggccttctacgccaccggccaagtgatcggcgacatccgcgaggcgcactgcaacatctccgagtccaagtggaacgagaccctgcagcgcgtgtccaagaagctgaaggagtacttccccgacaagaacatcaccttccagccgtcgtccggcggcgaccccgagatcaccacgcactccttcaactgcggtggcgagttcttctactgcaacacgtcgtccctgttcaaccgcacctacatggcgaactccaccgagaccaactccacgcgcaccatcacgctgcactgccgcatcaagcagatcatcaacatgtggcaggaggtgggccgcgccatgtacgcaccgcccatcgccggcaacatcacctgcatctccaacatcaccggcctcctgctgacccgcgacggcggcgagaacacccgggacggaggcaacaacaacacggagaccttcaggccagagggaggcaacatgaaggacaactggcgctccgagctgtacaagtacaaggtggtggaggtgaagcccctgggcgtggcacccaccaaggcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgacatcatctacgacctcctcgaggagtcccagaaccagcaggagaagaacgagcaggatctgctcgcgctggaccgctggaactccctgtggaactggttcaacatcaccaagtggctgtggtacatcaagatcttcatcatgatcgtgggcggcctgatcggcctgcgcatcatcttcgccgtgctgtcgctggtgaaccgcgtgcgccagggctgatgaggtaaccgggacccgaattcggatccagatctgctgtgcctt

SEQ ID NO: 87 - DNA, 2143 bp, Artificial Sequence; identical to SEQ ID NO: 30
  Description of Artificial Sequence: Synthetic polynucleotide

SEQ ID NO: 88 - protein, 694 aa, Artificial Sequence; identical to SEQ ID NO: 31
  Description of Artificial Sequence: Synthetic polypeptide

SEQ ID NO: 89 - protein, 694 aa, Artificial Sequence; identical to SEQ ID NO: 32
  Description of Artificial Sequence: Synthetic polypeptide

SEQ ID NO: 90 - protein, 694 aa, Artificial Sequence; identical to SEQ ID NO: 33
  Description of Artificial Sequence: Synthetic polypeptide

SEQ ID NO: 91 - protein, 694 aa, Artificial Sequence; identical to SEQ ID NO: 34
  Description of Artificial Sequence: Synthetic polypeptide

SEQ ID NO: 92 - protein, 698 aa, Artificial Sequence; identical to SEQ ID NO: 35
  Description of Artificial Sequence: Synthetic polypeptide

SEQ ID NO: 93 - protein, 707 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 94 - protein, 698 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEEMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNTAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGENNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 95 - protein, 696 aa, Artificial Sequence
  Description of Artificial Sequence: Synthetic polypeptide
MRVTGIQRNYPQWWIWSMLGLWMLMICNGMWVTVYYGVPVWKEAKTTLFCASDAKAYEKEVHNVWATHACVPTDPNPQEMVLKNVTENFNMWKNDMADQMHEDVISLWDQSLKPCVKLTPLCVTLNCIDANATASNATASNSSIIEGMKNCSFNITTELRDKIEKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRKAHCNISESKWNETLQRVSKKLKEYFPHKNITFQPSSGGDLEITTHSFNCGGEFFYCNTSSLFNRTYMANSTETNSTRTITLHCRIKQIINMWQEVGRAMYAPPIAGNITCISNITGLLLTRDGGNNNTTETFRPGGGNMKDNWRSELYKYKVVEIKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISDYTEIIYELLEESQNQQEKNEQDLLALDRWNSLWNWFNITNWLWYIKIFIMIVGGLIGLRIIFAVLSLVNRVRQG

SEQ ID NO: 96 - protein, 711 aa, Artificial Sequence
  Description of Artificial Sequence: Synthetic polypeptide
MKVRGIQRNYPQWWIWSMLGLWMLMICNGMWVTVYYGVPVWKEAKTTLFCASDAKAYEKEVHNVWATHACVPTDPNPQEMVLENVTENFNMWKNDMADQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQAFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPEGGNMKDNWRSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYDLLEESQNQQEKNEQDLLALDRWNSLWNWFNITKWLWYIKIFIMIVGGLIGLRIIFAVLSLVNRVRQG

SEQ ID NO: 97 - protein, 697 aa, Artificial Sequence; identical to SEQ ID NO: 36
  Description of Artificial Sequence: Synthetic polypeptide

SEQ ID NO: 98 - protein, 698 aa, Artificial Sequence; identical to SEQ ID NO: 35
  Description of Artificial Sequence: Synthetic polypeptide

SEQ ID NO: 99 - DNA, 32 bp, Artificial Sequence; identical to SEQ ID NO: 38
  Description of Artificial Sequence: Synthetic oligonucleotide

SEQ ID NO: 100 - DNA, 32 bp, Artificial Sequence; identical to SEQ ID NO: 39
  Description of Artificial Sequence: Synthetic oligonucleotide

SEQ ID NO: 101 - DNA, 32 bp, Artificial Sequence; identical to SEQ ID NO: 40
  Description of Artificial Sequence: Synthetic oligonucleotide

SEQ ID NO: 102 - DNA, 32 bp, Artificial Sequence; identical to SEQ ID NO: 41
  Description of Artificial Sequence: Synthetic oligonucleotide

SEQ ID NO: 103 - DNA, 32 bp, Artificial Sequence; identical to SEQ ID NO: 42
  Description of Artificial Sequence: Synthetic oligonucleotide

SEQ ID NO: 104 - DNA, 32 bp, Artificial Sequence
  Description of Artificial Sequence: Synthetic oligonucleotide
tagtaagaattcggtgaccgggtcccggatcc

SEQ ID NO: 105 - DNA, 1507 bp, Artificial Sequence; identical to SEQ ID NO: 44
  Description of Artificial Sequence: Synthetic polynucleotide

SEQ ID NO: 106 - DNA, 1507 bp, Artificial Sequence; identical to SEQ ID NO: 45
  Description of Artificial Sequence: Synthetic polynucleotide

SEQ ID NO: 107 - DNA, 1507 bp, Artificial Sequence; identical to SEQ ID NO: 46
  Description of Artificial Sequence: Synthetic polynucleotide

SEQ ID NO: 108 - DNA, 1507 bp, Artificial Sequence; identical to SEQ ID NO: 47
  Description of Artificial Sequence: Synthetic polynucleotide

SEQ ID NO: 109 - DNA, 1516 bp, Artificial Sequence; identical to SEQ ID NO: 48
  Description of Artificial Sequence: Synthetic polynucleotide

SEQ ID NO: 110 - DNA, 1546 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgaacgccaccgcgtccaactcctctatcatcgaggggatgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctcggagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacgtccaccgacatggccaactccaccgagaccaactccacgcgcatcatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcgagacgttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggtgaccgggtcccggatcc

SEQ ID NO: 111 - DNA, 1521 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgacgaacgccaccgcgtccaactcgtccatcatcgaggagatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacacggcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggcggcgagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagggtcccgaattcggttaccggatcc

SEQ ID NO: 112 - DNA, 1513 bp, Artificial Sequence
  Description of Artificial Sequence: Synthetic polynucleotide
gtcgacaagaagccaccatgcgcgtgacgggcatccagcgcaactacccgcagtggtggatctggtcgatgctgggcctctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcatcgacgccaacgcgaccgcgtccaacgcgacggcatccaactcgtccatcatcgaggggatgaagaactgctccttcaacatcacgacggagctgcgcgacaagatcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacgaacagcgcgaagaccatcatcgtgcacctgaacgagtccgtgaagatcgagtgcacccgcccgagcaacaacacgcgcacctccatccggatcggccctggccaggccttctacgccaccggccaggtgatcggcgacatccgcaaggcgcactgcaacatctccgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcacgatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacaacaccacggagaccttcaggccagggggaggcaacatgaaggacaactggcgctccgagctgtacaagtacaaggtggtggagatcaagcccctgggcgtggcacccaccaacgcccgcgagcgcgtcgtggagcgcgagaaggagtagtaagaattcggtaaccaggtcccggatcc

SEQ ID NO: 113 - DNA, 1558 bp, Artificial Sequence
  Description of Artificial Sequence: Synthetic polynucleotide
gtcgacaagaagccaccatgaaggtgcggggcatccagcgcaactacccgcagtggtggatctggtcgatgctgggcctctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctggagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcacggacgccaacgccaccgcgtcgaacaccaacgcgaccgcaagcaacatcaacgcgacggcgtcgaagtcctccatcatcgaggagatgaagaactgctccttcaacatcacgacggagctgcgcgacaagcgcgagaagaagtacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacagcaagaccatcatcgtgcacctgaacgagtccgtgaagatcgagtgcacccgcccgagcaacaacacgcgcacctccatccggatcggccctggccaggccttctacgccaccggccaagtgatcggcgacatccgcgaggcgcactgcaacatctccgagtccaagtggaacgagaccctgcagcgcgtgtccaagaagctgaaggagtacttccccgacaagaacatcaccttccagccgtcgtccggcggcgaccccgagatcaccacgcactccttcaactgcggtggcgagttcttctactgcaacacgtcgtccctgttcaaccgcacctacatggcgaactccaccgagaccaactccacgcgcaccatcacgctgcactgccgcatcaagcagatcatcaacatgtggcaggaggtgggccgcgccatgtacgcaccgcccatcgccggcaacatcacctgcatctccaacatcaccggcctcctgctgacccgcgacggcggcgagaacacccgggacggaggcaacaacaacacggagaccttcaggccagagggaggcaacatgaaggacaactggcgctccgagctgtacaagtacaaggtggtggaggtgaagcccctgggcgtggcacccaccaaggcccgcgagcgcgtcgtggagcgcgagaaggagtagtaaggtaaccgggacccgaattcggatcc

SEQ ID NO: 114 - DNA, 1519 bp, Artificial Sequence; identical to SEQ ID NO: 49
  Description of Artificial Sequence: Synthetic polynucleotide

SEQ ID NO: 115 - protein, 486 aa, Artificial Sequence; identical to SEQ ID NO: 50
  Description of Artificial Sequence: Synthetic polypeptide

SEQ ID NO: 116 - protein, 486 aa, Artificial Sequence; identical to SEQ ID NO: 51
  Description of Artificial Sequence: Synthetic polypeptide

SEQ ID NO: 117 - protein, 486 aa, Artificial Sequence; identical to SEQ ID NO: 52
  Description of Artificial Sequence: Synthetic polypeptide

SEQ ID NO: 118 - protein, 486 aa, Artificial Sequence; identical to SEQ ID NO: 53
  Description of Artificial Sequence: Synthetic polypeptide

SEQ ID NO: 119 - protein, 489 aa, Artificial Sequence; identical to SEQ ID NO: 54
  Description of Artificial Sequence: Synthetic polypeptide

SEQ ID NO: 120 - protein, 499 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARERVVEREKE

SEQ ID NO: 121 - protein, 490 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEEMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNTAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGENNTETFRPGGGNMKDNWRSELYKYKVVEVKPLGVAPTNARERVVEREKE

SEQ ID NO: 122 - protein, 488 aa, Artificial Sequence
  Description of Artificial Sequence: Synthetic polypeptide
MRVTGIQRNYPQWWIWSMLGLWMLMICNGVPVWKEAKTTLFCASDAKAYEKEVHNVWATHACVPTDPNPQEMVLKNVTENFNMWKNDMADQMHEDVISLWDQSLKPCVKLTPLCVTLNCIDANATASNATASNSSIIEGMKNCSFNITTELRDKIEKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRKAHCNISESKWNETLQRVSKKLKEYFPHKNITFQPSSGGDLEITTHSFNCGGEFFYCNTSSLFNRTYMANSTETNSTRTITLHCRIKQIINMWQEVGRAMYAPPIAGNITCISNITGLLLTRDGGNNNTTETFRPGGGNMKDNWRSELYKYKVVEIKPLGVAPTNARERVVEREKE

SEQ ID NO: 123 - protein, 503 aa, Artificial Sequence
  Description of Artificial Sequence: Synthetic polypeptide
MKVRGIQRNYPQWWIWSMLGLWMLMICNGVPVWKEAKTTLFCASDAKAYEKEVHNVWATHACVPTDPNPQEMVLENVTENFNMWKNDMADQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQAFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPEGGNMKDNWRSELYKYKVVEVKPLGVAPTKARERVVEREKE

SEQ ID NO: 124 - protein, 490 aa, Artificial Sequence; identical to SEQ ID NO: 55
  Description of Artificial Sequence: Synthetic polypeptide

SEQ ID NO: 125 - DNA, 2581 bp, Artificial Sequence; identical to SEQ ID NO: 56
  Description of Artificial Sequence: Synthetic polynucleotide

SEQ ID NO: 126 - DNA, 2581 bp, Artificial Sequence; identical to SEQ ID NO: 57
  Description of Artificial Sequence: Synthetic polynucleotide

SEQ ID NO: 127 - DNA, 2581 bp, Artificial Sequence; identical to SEQ ID NO: 58
  Description of Artificial Sequence: Synthetic polynucleotide

SEQ ID NO: 128 - DNA, 2581 bp, Artificial Sequence; identical to SEQ ID NO: 59
  Description of Artificial Sequence: Synthetic polynucleotide

SEQ ID NO: 129 - DNA, 2590 bp, Artificial Sequence; identical to SEQ ID NO: 60
  Description of Artificial Sequence: Synthetic polynucleotide

SEQ ID NO: 130 - DNA, 2620 bp, Artificial Sequence
  Description of Artificial Sequence: Synthetic polynucleotide
gtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgaacgccaccgcgtccaactcctctatcatcgaggggatgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctcggagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacgtccaccgacatggccaactccaccgagaccaactccacgcgcatcatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcgagacgttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggcgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaagaattcggtgaccgggtcccggatcc

SEQ ID NO: 131 - DNA, 2593 bp, Artificial Sequence
  Description of Artificial Sequence: Synthetic polynucleotide
gtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgacgaacgccaccgcgtccaactcgtccatcatcgaggagatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacacggcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggcggcgagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggtgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaagggtcccgaattcggttaccggatcc

SEQ ID NO: 132 - DNA, 2587 bp, Artificial Sequence
  Description of Artificial Sequence: Synthetic polynucleotide
gtcgacaagaaatgcgcgtgacgggcatccagcgcaactacccgcagtggtggatctggtcgatgctgggcctctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcatcgacgccaacgcgaccgcgtccaacgcgacggcatccaactcgtccatcatcgaggggatgaagaactgctccttcaacatcacgacggagctgcgcgacaagatcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacgaacagcgcgaagaccatcatcgtgcacctgaacgagtccgtgaagatcgagtgcacccgcccgagcaacaacacgcgcacctccatccggatcggccctggccaggccttctacgccaccggccaggtgatcggcgacatccgcaaggcgcactgcaacatctccgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcacgatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacaacaccacggagaccttcaggccagggggaggcaacatgaaggacaactggcgctccgagctgtacaagtacaaggtggtggagatcaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccgactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgacgccctccccccggggcccggacaggcccggtggcatcgaggaggagggcggcgagcaggaccgcaaccgctccacgcgcctggtgtccggcttcctggccctggcgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggcggcctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaagaattcggtaaccaggtcccggatcc

SEQ ID NO: 133 - DNA, 2632 bp, Artificial Sequence
  Description of Artificial Sequence: Synthetic polynucleotide
gtcgacaagaaatgaaggtgcggggcatccagcgcaactacccgcagtggtggatctggtcgatgctgggcctctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctggagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcacggacgccaacgccaccgcgtcgaacaccaacgcgaccgcaagcaacatcaacgcgacggcgtcgaagtcctccatcatcgaggagatgaagaactgctccttcaacatcacgacggagctgcgcgacaagcgcgagaagaagtacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacagcaagaccatcatcgtgcacctgaacgagtccgtgaagatcgagtgcacccgcccgagcaacaacacgcgcacctccatccggatcggccctggccaggccttctacgccaccggccaagtgatcggcgacatccgcgaggcgcactgcaacatctccgagtccaagtggaacgagaccctgcagcgcgtgtccaagaagctgaaggagtacttccccgacaagaacatcaccttccagccgtcgtccggcggcgaccccgagatcaccacgcactccttcaactgcggtggcgagttcttctactgcaacacgtcgtccctgttcaaccgcacctacatggcgaactccaccgagaccaactccacgcgcaccatcacgctgcactgccgcatcaagcagatcatcaacatgtggcaggaggtgggccgcgccatgtacgcaccgcccatcgccggcaacatcacctgcatctccaacatcaccggcctcctgctgacccgcgacggcggcgagaacacccgggacggaggcaacaacaacacggagaccttcaggccagagggaggcaacatgaaggacaactggcgctccgagctgtacaagtacaaggtggtggaggtgaagcccctgggcgtggcacccaccaaggcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgacatcatctacgacctcctcgaggagtcccagaaccagcaggagaagaacgagcaggatctgctcgcgctggaccgctggaactccctgtggaactggttcaacatcaccaagtggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggcgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggcgggctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaaggtaaccgggacccgaattcggatcc

SEQ ID NO: 134 - DNA, 2593 bp, Artificial Sequence; identical to SEQ ID NO: 61
  Description of Artificial Sequence: Synthetic polynucleotide

SEQ ID NO: 135 - protein, 846 aa, Artificial Sequence; identical to SEQ ID NO: 62
  Description of Artificial Sequence: Synthetic polypeptide

SEQ ID NO: 136 - protein, 846 aa, Artificial Sequence; identical to SEQ ID NO: 63
  Description of Artificial Sequence: Synthetic polypeptide

SEQ ID NO: 137 - protein, 846 aa, Artificial Sequence; identical to SEQ ID NO: 64
  Description of Artificial Sequence: Synthetic polypeptide

SEQ ID NO: 138 - protein, 846 aa, Artificial Sequence; identical to SEQ ID NO: 65
  Description of Artificial Sequence: Synthetic polypeptide

SEQ ID NO: 139 - protein, 849 aa, Artificial Sequence; identical to SEQ ID NO: 66
  Description of Artificial Sequence: Synthetic polypeptide

SEQ ID NO: 140 - protein, 859 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 141 - protein, 850 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEEMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNTAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGENNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 142 - protein, 848 aa, Artificial Sequence
  Description of Artificial Sequence: Synthetic polypeptide
MRVTGIQRNYPQWWIWSMLGLWMLMICNGMWVTVYYGVPVWKEAKTTLFCASDAKAYEKEVHNVWATHACVPTDPNPQEMVLKNVTENFNMWKNDMADQMHEDVISLWDQSLKPCVKLTPLCVTLNCIDANATASNATASNSSIIEGMKNCSFNITTELRDKIEKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRKAHCNISESKWNETLQRVSKKLKEYFPHKNITFQPSSGGDLEITTHSFNCGGEFFYCNTSSLFNRTYMANSTETNSTRTITLHCRIKQIINMWQEVGRAMYAPPIAGNITCISNITGLLLTRDGGNNNTTETFRPGGGNMKDNWRSELYKYKVVEIKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISDYTEIIYELLEESQNQQEKNEQDLLALDRWNSLWNWFNITNWLWYIKIFIMIVGGLIGLRIIFAVLSLVNRVRQGYSPLSLQTLTPSPRGPDRPGGIEEEGGEQDRNRSTRLVSGFLALAWDDLRSLCLFIYHRLRDFILIAARAGELLGRSSLKGLRRGWEALKYLGGLVQYWGLELKRSAISLLDTLAIAVGEGTDRILEFVLGICRAIRNIPTRIRQGFETALL

SEQ ID NO: 143 - protein, 863 aa, Artificial Sequence
  Description of Artificial Sequence: Synthetic polypeptide
MKVRGIQRNYPQWWIWSMLGLWMLMICNGMWVTVYYGVPVWKEAKTTLFCASDAKAYEKEVHNVWATHACVPTDPNPQEMVLENVTENFNMWKNDMADQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQAFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPEGGNMKDNWRSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGGLVQYWGLELKRSAISLLDTLAIAVGEGTDRILEFVLGICRAIRNIPTRIRQGFETALL

SEQ ID NO: 144 - protein, 850 aa, Artificial Sequence; identical to SEQ ID NO: 67
  Description of Artificial Sequence: Synthetic polypeptide

SEQ ID NO: 145 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaagaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtgaccgaattcgggacccggatcc

SEQ ID NO: 146 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtgaccgaattcaggtcccggatcc

SEQ ID NO: 147 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaacaactccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacgtccatccggatcggccctggccaggccttctacgccaccggccaggtgatcggcgacatccgcaaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagggacccgaattcggtcaccggatcc

SEQ ID NO: 148 - DNA, 1542 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcagcgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacacgagggacggaggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagggtcctgaattcggtaaccggatcc

SEQ ID NO: 149 - DNA, 1514 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgacaagaccatcatcgtgcacctgaacgagtccgtgaagatcgagtgcacccgcccgagcaacaagacgcgcacctccatccggatcggccctggccaggccttctacgccaccggccaggtgatcggcgacatccgcgaggcgtactgcaacatcagcgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaacatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacgacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtgatagtaagaggtcccggtaaccggatcc

SEQ ID NO: 150 - DNA, 1522 bp, Artificial Sequence
  Description of Artificial Sequence: Synthetic polynucleotide
gtcgacaagaagccaccatgcgcgtgcgcggcatccagcgcagctacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcatcaacgccaccaacgcgacggactcgaactccaacatcctcgaggggatgaagaactgctccttcaacatcacgacggagctgcgcgacaagcgcgagaagaagaacgccctgttctacaagctggacatcgtgcagctgggcggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaagaagtacttccccgacaagaacatcaccttccggccgtcgtccggcggcgacctcgagatcaccacgcactccttcaactgcggtggcgagttcttctactgcaacacgtcgtccctgttcaaccgcacctacatggcgacgtccaccgacatggccaactccaccgagacgaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagagggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtcaccgggtcccgaattcggatcc

SEQ ID NO: 151 - protein, 486 aa, Artificial Sequence; identical to SEQ ID NO: 50
  Description of Artificial Sequence: Synthetic polypeptide

SEQ ID NO: 152 - protein, 486 aa, Artificial Sequence; identical to SEQ ID NO: 51
  Description of Artificial Sequence: Synthetic polypeptide

SEQ ID NO: 153 - protein, 486 aa, Artificial Sequence; identical to SEQ ID NO: 52
  Description of Artificial Sequence: Synthetic polypeptide

SEQ ID NO: 154 - protein, 497 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNTRDGGKNNTETFRPGGGNMKDNWRSELYKYKVVEVKPLGVAPTNARERVVEREKE

SEQ ID NO: 155 - protein, 489 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPSNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRNITIHCRIKQIINMWQEVGRAMYAPPIAGNITCISNITGLLLTRDGGKNDTETFRPGGGNMKDNWRSELYKYKVVEVKPLGVAPTNARERVVEREKE

SEQ ID NO: 156 - protein, 491 aa, Artificial Sequence
  Description of Artificial Sequence: Synthetic polypeptide
MRVRGIQRSYPQWWIWSMLGFWMLMICNGVPVWKEAKTTLFCASDAKAYEKEVHNVWATHACVPTDPNPQEMVLKNVTENFNMWENDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARERVVEREKE

SEQ ID NO: 157 - DNA, 2582 bp, Artificial Sequence
  Description of Artificial Sequence: Synthetic polynucleotide
ggtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaagaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggtgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaaggtgaccgaattcgggacccggatcc

SEQ ID NO: 158 - DNA, 2582 bp, Artificial Sequence
  Description of Artificial Sequence: Synthetic polynucleotide
ggtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggtgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaaggtgaccgaattcaggtcccggatcc

SEQ ID NO: 159 - DNA, 2582 bp, Artificial Sequence
  Description of Artificial Sequence: Synthetic polynucleotide
ggtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaacaactccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacgtccatccggatcggccctggccaggccttctacgccaccggccaggtgatcggcgacatccgcaaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggtgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaagggacccgaattcggtcaccggatcc

SEQ ID NO: 160 - DNA, 2615 bp, Artificial Sequence
  Description of Artificial Sequence: Synthetic polynucleotide
ggtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcagcgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacacgagggacggaggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggcgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaagggtcctgaattcggtaaccggatcc

SEQ ID NO: 161 - DNA, 2592 bp, Artificial Sequence
  Description of Artificial Sequence: Synthetic polynucleotide
ggtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgacaagaccatcatcgtgcacctgaacgagtccgtgaagatcgagtgcacccgcccgagcaacaagacgcgcacctccatccggatcggccctggccaggccttctacgccaccggccaggtgatcggcgacatccgcgaggcgtactgcaacatcagcgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaacatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacgacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggtgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtgatgagaggtcccggtaaccggatcc

SEQ ID NO: 162 - DNA, 2597 bp, Artificial Sequence
  Description of Artificial Sequence: Synthetic polynucleotide
ggtcgacaagaaatgcgcgtgcgcggcatccagcgcagctacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcatcaacgccaccaacgcgacggactcgaactccaacatcctcgaggggatgaagaactgctccttcaacatcacgacggagctgcgcgacaagcgcgagaagaagaacgccctgttctacaagctggacatcgtgcagctgggcggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaagaagtacttccccgacaagaacatcaccttccggccgtcgtccggcggcgacctcgagatcaccacgcactccttcaactgcggtggcgagttcttctactgcaacacgtcgtccctgttcaaccgcacctacatggcgacgtccaccgacatggccaactccaccgagacgaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagagggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacgacgacatctgggacaacatgacctggatgcagtgggagcgcgagatctccaactacaccaacatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggcgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaaggtcaccgggtcccgaattcggatcc

SEQ ID NO: 163 - protein, 846 aa, Artificial Sequence; identical to SEQ ID NO: 62
  Description of Artificial Sequence: Synthetic polypeptide

SEQ ID NO: 164 - protein, 846 aa, Artificial Sequence; identical to SEQ ID NO: 63
  Description of Artificial Sequence: Synthetic polypeptide

SEQ ID NO: 165 - protein, 846 aa, Artificial Sequence; identical to SEQ ID NO: 64
  Description of Artificial Sequence: Synthetic polypeptide

SEQ ID NO: 166 - protein, 857 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 167 - protein, 849 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPSNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRNITIHCRIKQIINMWQEVGRAMYAPPIAGNITCISNITGLLLTRDGGKNDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFILGICRAIRNIPTRIRQGFETALL

SEQ ID NO: 168 - protein, 851 aa, Artificial Sequence
  Description of Artificial Sequence: Synthetic polypeptide
MRVRGIQRSYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 169 - DNA, 1509 bp, Artificial Sequence; identical to SEQ ID NO: 145
  Description of Artificial Sequence: Synthetic polynucleotide

SEQ ID NO: 170 - DNA, 1509 bp, Artificial Sequence; identical to SEQ ID NO: 146
  Description of Artificial Sequence: Synthetic polynucleotide

SEQ ID NO: 171 - DNA, 1509 bp, Artificial Sequence; identical to SEQ ID NO: 147
  Description of Artificial Sequence: Synthetic polynucleotide

SEQ ID NO: 172 - DNA, 1542 bp, Artificial Sequence; identical to SEQ ID NO: 148
  Description of Artificial Sequence: Synthetic polynucleotide

SEQ ID NO: 173 - DNA, 1514 bp, Artificial Sequence; identical to SEQ ID NO: 149
  Description of Artificial Sequence: Synthetic polynucleotide

SEQ ID NO: 174 - DNA, 1544 bp, Artificial Sequence
  Description of Artificial Sequence: Synthetic polynucleotide
ggtcgacaagaagccaccatgcgcgtgatgggccggcagcgcaactacccgcagtggtggatctggtcgatgctgggcctctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgacgccctgcgtgaagctgaccccgctgtgcgtgaccctgaactgcacggacgccaacgacaccgcgtcgaacagctccatcatcaaggggatgaacaactccatcgtgggggagatgaagaactgctccttcaacatcacgacggagctgcgcgacaagcgcgagaagaagaacgccctgttctacaagctggacatcgtgcagctggacggcaactcctcggagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacgcgaagaccatcatcgtgcacctgaacgagtccgtgaagatcgagtgcacccgcccgagcaacaacacgcgcacctccatccggatcggccctggccaggccttctacgccaccggccaggtgatcggcgacatccgcaaggcgcactgcaacatctccgagtccaagtggaacgagaccctgcagcgcgtgtccaagaagctgaaggagtacttccccgacaagaacatcaccttccagccgtcgtccggcggcgaccccgagatcaccacgcactccttcaactgcggtggcgagttcttctactgcaacacgtcgtccctgttcaaccgcacctacatggccaactcgacggacatggcgaactccgcggagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggaggcaactccagcacggagacggagaccttcaggccagggggaggcaacatgaaggacaactggcgctccgagctgtacaagtacaaggtggtggaggtgaagcccctgggcgtggcacccaccaacgcccgcgagcgcgtggtggagcgcgagaaggagtagtaaggtcaccgggacctgaattcggatcc

SEQ ID NO: 175 - protein, 486 aa, Artificial Sequence; identical to SEQ ID NO: 50
  Description of Artificial Sequence: Synthetic polypeptide

SEQ ID NO: 176 - protein, 486 aa, Artificial Sequence; identical to SEQ ID NO: 51
  Description of Artificial Sequence: Synthetic polypeptide

SEQ ID NO: 177 - protein, 486 aa, Artificial Sequence; identical to SEQ ID NO: 52
  Description of Artificial Sequence: Synthetic polypeptide

SEQ ID NO: 178 - protein, 497 aa, Artificial Sequence; identical to SEQ ID NO: 154
  Description of Artificial Sequence: Synthetic polypeptide

SEQ ID NO: 179 - protein, 489 aa, Artificial Sequence; identical to SEQ ID NO: 155
  Description of Artificial Sequence: Synthetic polypeptide

SEQ ID NO: 180 - protein, 498 aa, Artificial Sequence
  Description of Artificial Sequence: Synthetic polypeptide
MRVMGRQRNYPQWWIWSMLGLWMLMICNGVPVWKEAKTTLFCASDAKAYEKEVHNVWATHACVPTDPNPQEMVLKNVTENFNMWKNDMVDQMHEDVISLWDQSLTPCVKLTPLCVTLNCTDANDTASNSSIIKGMNNSIVGEMKNCSFNITTELRDKREKKNALFYKLDIVQLDGNSSEYRLINCNTSVITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIRIGPGQAFYATGQVIGDIRKAHCNISESKWNETLQRVSKKLKEYFPDKNITFQPSSGGDPEITTHSFNCGGEFFYCNTSSLFNRTYMANSTDMANSAETNSTRTITLHCRIKQIINMWQEVGRAMYAPPIAGNITCISNITGLLLTRDGGNSSTETETFRPGGGNMKDNWRSELYKYKVVEVKPLGVAPTNARERVVEREKE

SEQ ID NO: 181 - DNA, 2131 bp, Artificial Sequence; identical to SEQ ID NO: 25
  Description of Artificial Sequence: Synthetic polynucleotide

SEQ ID NO: 182 - DNA, 2131 bp, Artificial Sequence; identical to SEQ ID NO: 26
  Description of Artificial Sequence: Synthetic polynucleotide

SEQ ID NO: 183 - DNA, 2125 bp, Artificial Sequence
  Description of Artificial Sequence: Synthetic polynucleotide
gtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaacaactccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacgtccatccggatcggccctggccaggccttctacgccaccggccaggtgatcggcgacatccgcaaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagggacccgaattcggtcaccggatcc

SEQ ID NO: 184 - DNA, 2164 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcagcgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacacgagggacggaggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagggtcctgaattcggtaaccggatcc

SEQ ID NO: 185 - DNA, 2129 bp, Artificial Sequence
  Description of Artificial Sequence: Synthetic polynucleotide
gtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgacaagaccatcatcgtgcacctgaacgagtccgtgaagatcgagtgcacccgcccgagcaacaagacgcgcacctccatccggatcggccctggccaggccttctacgccaccggccaggtgatcggcgacatccgcgaggcgtactgcaacatcagcgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaacatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacgacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaggtcccggtaaccggatcc

SEQ ID NO: 186 - DNA, 2168 bp, Artificial Sequence
  Description of Artificial Sequence: Synthetic polynucleotide
ggtcgacaagaagccaccatgcgcgtgatgggccggcagcgcaactacccgcagtggtggatctggtcgatgctgggcctctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgacgccctgcgtgaagctgaccccgctgtgcgtgaccctgaactgcacggacgccaacgacaccgcgtcgaacagctccatcatcaaggggatgaacaactccatcgtgggggagatgaagaactgctccttcaacatcacgacggagctgcgcgacaagcgcgagaagaagaacgccctgttctacaagctggacatcgtgcagctggacggcaactcctcggagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacgcgaagaccatcatcgtgcacctgaacgagtccgtgaagatcgagtgcacccgcccgagcaacaacacgcgcacctccatccggatcggccctggccaggccttctacgccaccggccaggtgatcggcgacatccgcaaggcgcactgcaacatctccgagtccaagtggaacgagaccctgcagcgcgtgtccaagaagctgaaggagtacttccccgacaagaacatcaccttccagccgtcgtccggcggcgaccccgagatcaccacgcactccttcaactgcggtggcgagttcttctactgcaacacgtcgtccctgttcaaccgcacctacatggccaactcgacggacatggcgaactccgcggagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggaggcaactccagcacggagacggagaccttcaggccagggggaggcaacatgaaggacaactggcgctccgagctgtacaagtacaaggtggtggaggtgaagcccctgggcgtggcacccaccaacgcccgcaggcgcgtggtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgcggctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacgacgacatctgggacaacatgacctggatgcagtgggagggggagatctccaactacaccaacatcatctacgacctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcggatcatcttcgccgtgctgtcgctggtgaaccgcgtgcgccagggctgatgaggtcaccgggacctgaattcggatcc

SEQ ID NO: 187 - protein, 694 aa, Artificial Sequence; identical to SEQ ID NO: 31
  Description of Artificial Sequence: Synthetic polypeptide

SEQ ID NO: 188 - protein, 694 aa, Artificial Sequence; identical to SEQ ID NO: 32
  Description of Artificial Sequence: Synthetic polypeptide

SEQ ID NO: 189 - protein, 694 aa, Artificial Sequence; identical to SEQ ID NO: 33
  Description of Artificial Sequence: Synthetic polypeptide

SEQ ID NO: 190 - protein, 705 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 191 - protein, 697 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPSNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRNITIHCRIKQIINMWQEVGRAMYAPPIAGNITCISNITGLLLTRDGGKNDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 192 - protein, 706 aa, Artificial Sequence
  Description of Artificial Sequence: Synthetic polypeptide
MRVMGRQRNYPQWWIWSMLGLWMLMICNGMWVTVYYGVPVWKEAKTTLFCASDAKAYEKEVHNVWATHACVPTDPNPQEMVLKNVTENFNMWKNDMVDQMHEDVISLWDQSLTPCVKLTPLCVTLNCTDANDTASNSSIIKGMNNSIVGEMKNCSFNITTELRDKREKKNALFYKLDIVQLDGNSSEYRLINCNTSVITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIRIGPGQAFYATGQVIGDIRKAHCNISESKWNETLQRVSKKLKEYFPDKNITFQPSSGGDPEITTHSFNCGGEFFYCNTSSLFNRTYMANSTDMANSAETNSTRTITLHCRIKQIINMWQEVGRAMYAPPIAGNITCISNITGLLLTRDGGNSSTETETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLRLTVWGIKQLQARVLALERYLKDQQLLGMWGCSGKLICTTNVYWNSSWSNKTYDDIWDNMTWMQWEGEISNYTNIIYDLLEESQNQQEKNEQDLLALDRWNSLWNWFNITNWLWYIKIFIMIVGGLIGLRIIFAVLSLVNRVRQG

SEQ ID NO: 193 - DNA, 2613 bp, Artificial Sequence
  Description of Artificial Sequence: Synthetic polynucleotide
gtcgtcgacaagaagccaccatgcgcgtgatgggccggcagcgcaactacccgcagtggtggatctggtcgatgctgggcctctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgacgccctgcgtgaagctgaccccgctgtgcgtgaccctgaactgcacggacgccaacgacaccgcgtcgaacagctccatcatcaaggggatgaacaactccatcgtgggggagatgaagaactgctccttcaacatcacgacggagctgcgcgacaagcgcgagaagaagaacgccctgttctacaagctggacatcgtgcagctggacggcaactcctcggagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacgcgaagaccatcatcgtgcacctgaacgagtccgtgaagatcgagtgcacccgcccgagcaacaacacgcgcacctccatccggatcggccctggccaggccttctacgccaccggccaggtgatcggcgacatccgcaaggcgcactgcaacatctccgagtccaagtggaacgagaccctgcagcgcgtgtccaagaagctgaaggagtacttccccgacaagaacatcaccttccagccgtcgtccggcggcgaccccgagatcaccacgcactccttcaactgcggtggcgagttcttctactgcaacacgtcgtccctgttcaaccgcacctacatggccaactcgacggacatggcgaactccgcggagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggaggcaactccagcacggagacggagaccttcaggccagggggaggcaacatgaaggacaactggcgctccgagctgtacaagtacaaggtggtggaggtgaagcccctgggcgtggcacccaccaacgcccgcaggcgcgtggtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgcggctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacgacgacatctgggacaacatgacctggatgcagtgggagggggagatctccaactacaccaacatcatctacgacctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcggatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaagcgctccacgcgcctggtgtccggcttcctggccctggtgtgggacgacctgcgctccctgtgcctgttcctctaccaccgcctgcgcgacttcatcctgatcgcggcccgcgctggcgagctgctgggccggtcctcgctgaagggcctgcgccgcggctgggaggccctgaagtacctgggcagcctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtgatgaggtcaccgggacc

SEQ ID NO: 194 - protein, 858 aa, Artificial Sequence
  Description of Artificial Sequence: Synthetic polypeptide
MRVMGRQRNYPQWWIWSMLGLWMLMICNGMWVTVYYGVPVWKEAKTTLFCASDAKAYEKEVHNVWATHACVPTDPNPQEMVLKNVTENFNMWKNDMVDQMHEDVISLWDQSLTPCVKLTPLCVTLNCTDANDTASNSSIIKGMNNSIVGEMKNCSFNITTELRDKREKKNALFYKLDIVQLDGNSSEYRLINCNTSVITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIRIGPGQAFYATGQVIGDIRKAHCNISESKWNETLQRVSKKLKEYFPDKNITFQPSSGGDPEITTHSFNCGGEFFYCNTSSLFNRTYMANSTDMANSAETNSTRTITLHCRIKQIINMWQEVGRAMYAPPIAGNITCISNITGLLLTRDGGNSSTETETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLRLTVWGIKQLQARVLALERYLKDQQLLGMWGCSGKLICTTNVYWNSSWSNKTYDDIWDNMTWMQWEGEISNYTNIIYDLLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRKRSTRLVSGFLALVWDDLRSLCLFLYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 195 - DNA, 1947 bp, Artificial Sequence
  Description of Artificial Sequence: Synthetic polynucleotide
atgcccatgggcagcctgcagcccctggccaccctgtacctgctgggcatgctggtggctagcgtgctggccgccgagaacctgtgggtgaccgtctactatggcgtgcccgtctggaaggaagccaaaaccacactgttctgcgctagcgacgctaaggcatacgagaaagaagtgcacaatgtctgggctactcatgcatgcgtgcctaccgatccaaatccccaggagatggtgctgaagaacgtcacagaaaactttaatatgtggaagaacgacatggtggatcagatgcacgaggacgtgatcagcctgtgggatcagtccctgaagccatgcgtgaaactgactcccctgtgcgtcaccctgaactgtactaatgccaccgcttccaacagctccatcattgaggggatgaagaactgttctttcaatatcactaccgagctgcgcgacaagcgagaaaagaaaaatgccctgttttacaaactggacatcgtgcagctggatggcaactctagtcagtatagactgattaactgcaatacaagcgtgatcactcaggcatgtccaaaggtcagtttcgatcctattccaatccactactgcgcacccgccggatatgctatcctgaagtgtaacaacaagaccttcaccggcactgggccttgcaacaacgtgagcaccgtccagtgtacacatggcattaagccagtggtcagcacccagctgctgctgaacggcagcctggcagagggcgaaatcattatccgcagcgagaacatcacaaataatgtgaagactatcatcgtccacctgaacgagagcgtgaagattgaatgcacacggcccaacaacaagaccaggacatccattcgcatcggacctggccaggccttctacgctactggccaggtcatcggggacatcagagaggcctattgtaacatcaatgagtcaaagtggaatgaaactctgcagagggtgagcaagaaactgaaggaatacttccctcacaaaaacatcacctttcagccatcaagcggcggggacctggagattacaactcattctttcaattgcggaggcgaattcttttactgtaacacctcctctctgtttaatcgcacatatatggctaacagtactgatatggcaaactctactgagaccaatagtacacgaactattaccatccattgccggatcaagcagattatcaacatgtggcaggaagtggggcgggccatgtatgctccccctattgcaggaaatattacctgtatcagcaacattaccggcctgctgctgacaagagacgggggaaagaacaatacagagacttttaggcctggcgggggaaacatgaaagataattggcgctccgagctgtacaagtataaagtggtcaagatcgaaccactgggagtggcacctacccgatgtaaacggagagtggtcggaaggcgccgacggagaagggcagtgggaatcggagccgtcttcctgggctttctgggagcagctggcagcacaatgggagcagcctctatgaccctgacagtgcaggctcgaaatctgctgagtgggatcgtgcagcagcagtcaaacctgctgcgagcaccagaggcacagcagcatctgctgaagctgaccgtgtggggcatcaagcagctgcaggccagagtgctggctgtcgaacggtacctgagagatcagcagctgctgggaatctggggatgcagcggaaagctgatttgctgtacaaacgtgccctggaatagttcatggtcaaacaggaatctgagcgagatctgggacaatatgacctggctgcagtgggataaggaaatcagtaactacacacagatcatctatggcctgctggaggaatcacagaaccagcaggagaaaaatgaacaggacctgctggccctggattgatga

SEQ ID NO: 196 - DNA, 1977 bp, Artificial Sequence
  Description of Artificial Sequence: Synthetic polynucleotide
atggggagcctgcagcctctggcaaccctgtatctgctgggaatgctggtcgcaagtgtcctggccgccgaaaacctgtgggtcaccgtgtattatggagtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgaacgccaccgcgtccaactcctctatcatcgaggggatgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctcggagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacgtccaccgacatggccaactccaccgagaccaactccacgcgcatcatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcgagacgttcaggccaggcggaggcaacatgaaggataactggaggtccgagctgtacaagtataaagtggtcaagatcgaacctctgggagtggcaccaaccagatgcaagcgaagagtggtcggacgaaggaggaggaggcgagcagtcggaattggggccgtgttcctgggatttctgggcgccgctgggagtacaatgggagcagcctcaatgactctgaccgtgcaggccaggaatctgctgagcggcatcgtccagcagcagtccaacctgctgcgcgctcctgaagcacagcagcacctgctgaagctgaccgtgtggggcatcaaacagctgcaggctagggtgctggcagtcgagcggtacctgagagaccagcagctgctgggaatctggggctgctctgggaagctgatttgttgcacaaatgtgccttggaactctagttggtcaaatcgcaacctgagcgagatctgggacaatatgacttggctgcagtgggataaagaaattagtaactacacccagatcatctacggcctgctggaagagtcacagaatcagcaggagaagaacgaacaggacctgctggcactggattga

SEQ ID NO: 197 - DNA, 1944 bp, Artificial Sequence
  Description of Artificial Sequence: Synthetic polynucleotide
atggggagcctgcagcctctggcaaccctgtatctgctgggaatgctggtcgcaagtgtcctggccgccgaaaacctgtgggtcaccgtgtattatggagtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcatcgacgccaacgcgaccgcgtccaacgcgacggcatccaactcgtccatcatcgaggggatgaagaactgctccttcaacatcacgacggagctgcgcgacaagatcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacgaacagcgcgaagaccatcatcgtgcacctgaacgagtccgtgaagatcgagtgcacccgcccgagcaacaacacgcgcacctccatccggatcggccctggccaggccttctacgccaccggccaggtgatcggcgacatccgcaaggcgcactgcaacatctccgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcacgatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacaacaccacggagaccttcaggccagggggaggcaacatgaaggataactggaggtccgagctgtacaagtataaagtggtcaagatcgaacctctgggagtggcaccaaccagatgcaagcgaagagtggtcggacgaaggaggaggaggcgagcagtcggaattggggccgtgttcctgggatttctgggcgccgctgggagtacaatgggagcagcctcaatgactctgaccgtgcaggccaggaatctgctgagcggcatcgtccagcagcagtccaacctgctgcgcgctcctgaagcacagcagcacctgctgaagctgaccgtgtggggcatcaaacagctgcaggctagggtgctggcagtcgagcggtacctgagagaccagcagctgctgggaatctggggctgctctgggaagctgatttgttgcacaaatgtgccttggaactctagttggtcaaatcgcaacctgagcgagatctgggacaatatgacttggctgcagtgggataaagaaattagtaactacacccagatcatctacggcctgctggaagagtcacagaatcagcaggagaagaacgaacaggacctgctggcactggattga

SEQ ID NO: 198 - DNA, 1989 bp, Artificial Sequence
  Description of Artificial Sequence: Synthetic polynucleotide
atggggagcctgcagcctctggcaaccctgtatctgctgggaatgctggtcgcaagtgtcctggccgccgaaaacctgtgggtcaccgtgtattatggagtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctggagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcacggacgccaacgccaccgcgtcgaacaccaacgcgaccgcaagcaacatcaacgcgacggcgtcgaagtcctccatcatcgaggagatgaagaactgctccttcaacatcacgacggagctgcgcgacaagcgcgagaagaagtacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacagcaagaccatcatcgtgcacctgaacgagtccgtgaagatcgagtgcacccgcccgagcaacaacacgcgcacctccatccggatcggccctggccaggccttctacgccaccggccaagtgatcggcgacatccgcgaggcgcactgcaacatctccgagtccaagtggaacgagaccctgcagcgcgtgtccaagaagctgaaggagtacttccccgacaagaacatcaccttccagccgtcgtccggcggcgaccccgagatcaccacgcactccttcaactgcggtggcgagttcttctactgcaacacgtcgtccctgttcaaccgcacctacatggcgaactccaccgagaccaactccacgcgcaccatcacgctgcactgccgcatcaagcagatcatcaacatgtggcaggaggtgggccgcgccatgtacgcaccgcccatcgccggcaacatcacctgcatctccaacatcaccggcctcctgctgacccgcgacggcggcgagaacacccgggacggaggcaacaacaacacggagaccttcaggccagagggaggcaacatgaaggataactggaggtccgagctgtacaagtataaagtggtcaagatcgaacctctgggagtggcaccaaccagatgcaagcgaagagtggtcggacgaaggaggaggaggcgagcagtcggaattggggccgtgttcctgggatttctgggcgccgctgggagtacaatgggagcagcctcaatgactctgaccgtgcaggccaggaatctgctgagcggcatcgtccagcagcagtccaacctgctgcgcgctcctgaagcacagcagcacctgctgaagctgaccgtgtggggcatcaaacagctgcaggctagggtgctggcagtcgagcggtacctgagagaccagcagctgctgggaatctggggctgctctgggaagctgatttgttgcacaaatgtgccttggaactctagttggtcaaatcgcaacctgagcgagatctgggacaatatgacttggctgcagtgggataaagaaattagtaactacacccagatcatctacggcctgctggaagagtcacagaatcagcaggagaagaacgaacaggacctgctggcactggattga

SEQ ID NO: 199 - DNA, 1947 bp, Artificial Sequence
  Description of Artificial Sequence: Synthetic polynucleotide
atgcccatgggcagcctgcagcccctggccaccctgtacctgctgggcatgctggtggctagcgtgctggccgccgagaacctgtgggtgaccgtctactatggcgtgcccgtctggaaggaagccaaaaccacactgttctgcgctagcgacgctaaggcatacgagaaagaagtgcacaatgtctgggctactcatgcatgcgtgcctaccgatccaaatccccaggagatggtgctgaagaacgtcacagaaaactttaatatgtggaagaacgacatggtggatcagatgcacgaggacgtgatcagcctgtgggatcagtccctgaagccatgcgtgaaactgactcccctgtgcgtcaccctgaactgtactaatgccaccgcttccaacagctccatcattgaggggatgaagaactgttctttcaatatcactaccgagctgcgcgacaagcgagaaaagaaaaatgccctgttttacaaactggacatcgtgcagctggatggcaactctagtcagtatagactgattaactgcaatacaagcgtgtgcactcaggcatgtccaaaggtcagtttcgatcctattccaatccactactgcgcacccgccggatatgctatcctgaagtgtaacaacaagaccttcaccggcactgggccttgcaacaacgtgagcaccgtccagtgtacacatggcattaagccagtggtcagcacccagctgctgctgaacggcagcctggcagagggcgaaatcattatccgcagcgagaacatcacaaataatgtgaagactatcatcgtccacctgaacgagagcgtgaagattgaatgcacacggcccaacaacaagaccaggacatccattcgcatcggacctggccaggccttctacgctactggccaggtcatcggggacatcagagaggcctattgtaacatcaatgagtcaaagtggaatgaaactctgcagagggtgagcaagaaactgaaggaatacttccctcacaaaaacatcacctttcagccatcaagcggcggggacctggagattacaactcattctttcaattgcggaggcgaattcttttactgtaacacctcctctctgtttaatcgcacatatatggctaacagtactgatatggcaaactctactgagaccaatagtacacgaactattaccatccattgccggatcaagcagattatcaacatgtggcaggaagtggggcggtgcatgtatgctccccctattgcaggaaatattacctgtatcagcaacattaccggcctgctgctgacaagagacgggggaaagaacaatacagagacttttaggcctggcgggggaaacatgaaagataattggcgctccgagctgtacaagtataaagtggtcaagatcgaaccactgggagtggcacctacccgatgtaaacggagagtggtcggaaggcgccgacggagaagggcagtgggaatcggagccgtcttcctgggctttctgggagcagctggcagcacaatgggagcagcctctatgaccctgacagtgcaggctcgaaatctgctgagtgggatcgtgcagcagcagtcaaacctgctgcgagcaccagaggcacagcagcatctgctgaagctgaccgtgtggggcatcaagcagctgcaggccagagtgctggctgtcgaacggtacctgagagatcagcagctgctgggaatctggggatgcagcggaaagctgatttgctgtacaaacgtgccctggaatagttcatggtcaaacaggaatctgagcgagatctgggacaatatgacctggctgcagtgggataaggaaatcagtaactacacacagatcatctatggcctgctggaggaatcacagaaccagcaggagaaaaatgaacaggacctgctggccctggattgatga

SEQ ID NO: 200 - DNA, 1977 bp, Artificial Sequence
  Description of Artificial Sequence: Synthetic polynucleotide
atggggagcctgcagcctctggcaaccctgtatctgctgggaatgctggtcgcaagtgtcctggccgccgaaaacctgtgggtcaccgtgtattatggagtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgaacgccaccgcgtccaactcctctatcatcgaggggatgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtctgcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctcggagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacgtccaccgacatggccaactccaccgagaccaactccacgcgcatcatcacgatccggtgccgcatcaagcagatcatcaacatgtggcaggaggtgggccgctgcatgtacgcaccgcccatcgccggcaacatcacctgcatctccaacatcaccggcctcctgctgacccgcgacggcggcaagaacaacacggagaccttcgagacgttcaggccaggcggaggcaacatgaaggataactggaggtccgagctgtacaagtataaagtggtcaagatcgaacctctgggagtggcaccaaccagatgcaagcgaagagtggtcggacgaaggaggaggaggcgagcagtcggaattggggccgtgttcctgggatttctgggcgccgctgggagtacaatgggagcagcctcaatgactctgaccgtgcaggccaggaatctgctgagcggcatcgtccagcagcagtccaacctgctgcgcgctcctgaagcacagcagcacctgctgaagctgaccgtgtggggcatcaaacagctgcaggctagggtgctggcagtcgagcggtacctgagagaccagcagctgctgggaatctggggctgctctgggaagctgatttgttgcacaaatgtgccttggaactctagttggtcaaatcgcaacctgagcgagatctgggacaatatgacttggctgcagtgggataaagaaattagtaactacacccagatcatctacggcctgctggaagagtcacagaatcagcaggagaagaacgaacaggacctgctggcactggattga

SEQ ID NO: 201 - DNA, 1944 bp, Artificial Sequence
  Description of Artificial Sequence: Synthetic polynucleotide
atggggagcctgcagcctctggcaaccctgtatctgctgggaatgctggtcgcaagtgtcctggccgccgaaaacctgtgggtcaccgtgtattatggagtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcatcgacgccaacgcgaccgcgtccaacgcgacggcatccaactcgtccatcatcgaggggatgaagaactgctccttcaacatcacgacggagctgcgcgacaagatcgagaagaagaacgccctgttctacaagctggacatcgtgcagctggacggcaactcctcgcagtacaggctgatcaactgcaacacctccgtctgcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacgaacagcgcgaagaccatcatcgtgcacctgaacgagtccgtgaagatcgagtgcacccgcccgagcaacaacacgcgcacctccatccggatcggccctggccaggccttctacgccaccggccaggtgatcggcgacatccgcaaggcgcactgcaacatctccgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcacgatcacgctccactgccgcatcaagcagatcatcaacatgtggcaggaggtgggccgctgcatgtacgcaccgcccatcgccggcaacatcacctgcatctccaacatcaccggcctcctgctgacccgcgacggcggcaacaacaacaccacggagaccttcaggccagggggaggcaacatgaaggataactggaggtccgagctgtacaagtataaagtggtcaagatcgaacctctgggagtggcaccaaccagatgcaagcgaagagtggtcggacgaaggaggaggaggcgagcagtcggaattggggccgtgttcctgggatttctgggcgccgctgggagtacaatgggagcagcctcaatgactctgaccgtgcaggccaggaatctgctgagcggcatcgtccagcagcagtccaacctgctgcgcgctcctgaagcacagcagcacctgctgaagctgaccgtgtggggcatcaaacagctgcaggctagggtgctggcagtcgagcggtacctgagagaccagcagctgctgggaatctggggctgctctgggaagctgatttgttgcacaaatgtgccttggaactctagttggtcaaatcgcaacctgagcgagatctgggacaatatgacttggctgcagtgggataaagaaattagtaactacacccagatcatctacggcctgctggaagagtcacagaatcagcaggagaagaacgaacaggacctgctggcactggattga

SEQ ID NO: 202 - DNA, 1989 bp, Artificial Sequence
  Description of Artificial Sequence: Synthetic polynucleotide
atggggagcctgcagcctctggcaaccctgtatctgctgggaatgctggtcgcaagtgtcctggccgccgaaaacctgtgggtcaccgtgtattatggagtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctggagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcacggacgccaacgccaccgcgtcgaacaccaacgcgaccgcaagcaacatcaacgcgacggcgtcgaagtcctccatcatcgaggagatgaagaactgctccttcaacatcacgacggagctgcgcgacaagcgcgagaagaagtacgccctgttctacaagctggacatcgtgcagctggacggcaactcctcgcagtacaggctgatcaactgcaacacctccgtctgcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacagcaagaccatcatcgtgcacctgaacgagtccgtgaagatcgagtgcacccgcccgagcaacaacacgcgcacctccatccggatcggccctggccaggccttctacgccaccggccaagtgatcggcgacatccgcgaggcgcactgcaacatctccgagtccaagtggaacgagaccctgcagcgcgtgtccaagaagctgaaggagtacttccccgacaagaacatcaccttccagccgtcgtccggcggcgaccccgagatcaccacgcactccttcaactgcggtggcgagttcttctactgcaacacgtcgtccctgttcaaccgcacctacatggcgaactccaccgagaccaactccacgcgcaccatcacgctgcactgccgcatcaagcagatcatcaacatgtggcaggaggtgggccgctgcatgtacgcaccgcccatcgccggcaacatcacctgcatctccaacatcaccggcctcctgctgacccgcgacggcggcgagaacacccgggacggaggcaacaacaacacggagaccttcaggccagagggaggcaacatgaaggataactggaggtccgagctgtacaagtataaagtggtcaagatcgaacctctgggagtggcaccaaccagatgcaagcgaagagtggtcggacgaaggaggaggaggcgagcagtcggaattggggccgtgttcctgggatttctgggcgccgctgggagtacaatgggagcagcctcaatgactctgaccgtgcaggccaggaatctgctgagcggcatcgtccagcagcagtccaacctgctgcgcgctcctgaagcacagcagcacctgctgaagctgaccgtgtggggcatcaaacagctgcaggctagggtgctggcagtcgagcggtacctgagagaccagcagctgctgggaatctggggctgctctgggaagctgatttgttgcacaaatgtgccttggaactctagttggtcaaatcgcaacctgagcgagatctgggacaatatgacttggctgcagtgggataaagaaattagtaactacacccagatcatctacggcctgctggaagagtcacagaatcagcaggagaagaacgaacaggacctgctggcactggattga

SEQ ID NO: 203 - DNA, 1944 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaagaacgtgaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatcaacgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 204 - DNA, 1944 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcgcaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaagaacgtgaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatcaacgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 205 - DNA, 1944 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccgacaacggcaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatcaacgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 206 - DNA, 1944 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcgcaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccgacaacggcaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatcaacgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 207 - DNA, 1983 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaacgccaccgcctccaactcctccatcatcgagggcatgaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccgacaacggcaagaccatcatcgtgcacctgaacgagtccgtgaagatcgagtgcacccgcccctccaacaacacccgcacctccatccgcatcggccccggccagtggttctacgccaccggccaggtgatcggcgacatccgcgaggcccactgcaacatctccgagtccaagtggaacgagaccctgcagcgcgtgtccgagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccacctccaccgacatggccaactccaccgagaccaactccacccgcatcatcaccatccgctgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttcgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 208 - DNA, 1983 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcgcaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaacgccaccgcctccaactcctccatcatcgagggcatgaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccgacaacggcaagaccatcatcgtgcacctgaacgagtccgtgaagatcgagtgcacccgcccctccaacaacacccgcacctccatccgcatcggccccggccagtggttctacgccaccggccaggtgatcggcgacatccgcgaggcccactgcaacatctccgagtccaagtggaacgagaccctgcagcgcgtgtccgagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccacctccaccgacatggccaactccaccgagaccaactccacccgcatcatcaccatccgctgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttcgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 209 - DNA, 1950 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggccgaccagatgcacgaggacgtgatctccctgtgggaccagtccctgaagccctgcgtgaagctgacccccctgtgcgtgaccctgaactgcatcgacgccaacgccaccgcctccaacgccaccgcctccaactcctccatcatcgagggcatgaagaactgctccttcaacatcaccaccgagctgcgcgacaagatcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccaactccgccaagaccatcatcgtgcacctgaacgagtccgtgaagatcgagtgcacccgcccctccaacaacacccgcacctccatccgcatcggccccggccagtggttctacgccaccggccaggtgatcggcgacatccgcaaggcccactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgagaccaactccacccgcaccatcaccctgcactgccgcatcaagcagatcatcaacatgtggcaggaggtgggccgcgccatgtacgccccccccatcgccggcaacatcacctgcatctccaacatcaccggcctgctgctgacccgcgacggcggcaacaacaacaccaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 210 - DNA, 1950 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcgcaacgtgtgggccacccacgcctgcgtgcccaccgaccccaacccccaggagatggtgctgaagaacgtgaccgagaacttcaacatgtggaagaacgacatggccgaccagatgcacgaggacgtgatctccctgtgggaccagtccctgaagccctgcgtgaagctgacccccctgtgcgtgaccctgaactgcatcgacgccaacgccaccgcctccaacgccaccgcctccaactcctccatcatcgagggcatgaagaactgctccttcaacatcaccaccgagctgcgcgacaagatcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccaactccgccaagaccatcatcgtgcacctgaacgagtccgtgaagatcgagtgcacccgcccctccaacaacacccgcacctccatccgcatcggccccggccagtggttctacgccaccggccaggtgatcggcgacatccgcaaggcccactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgagaccaactccacccgcaccatcaccctgcactgccgcatcaagcagatcatcaacatgtggcaggaggtgggccgcgccatgtacgccccccccatcgccggcaacatcacctgcatctccaacatcaccggcctgctgctgacccgcgacggcggcaacaacaacaccaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 211 - DNA, 1995 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctggagaacgtgaccgagaacttcaacatgtggaagaacgacatggccgaccagatgcacgaggacgtgatctccctgtgggaccagtccctgaagccctgcgtgaagctgacccccctgtgcgtgaccctgaactgcaccgacgccaacgccaccgcctccaacaccaacgccaccgcctccaacatcaacgccaccgcctccaagtcctccatcatcgaggagatgaagaactgctccttcaacatcaccaccgagctgcgcgacaagcgcgagaagaagtacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccgacaactccaagaccatcatcgtgcacctgaacgagtccgtgaagatcgagtgcacccgcccctccaacaacacccgcacctccatccgcatcggccccggccagtggttctacgccaccggccaggtgatcggcgacatccgcgaggcccactgcaacatctccgagtccaagtggaacgagaccctgcagcgcgtgtccaagaagctgaaggagtacttccccgacaagaacatcaccttccagccctcctccggcggcgaccccgagatcaccacccactccttcaactgcggcggcgagttcttctactgcaacacctcctccctgttcaaccgcacctacatggccaactccaccgagaccaactccacccgcaccatcaccctgcactgccgcatcaagcagatcatcaacatgtggcaggaggtgggccgcgccatgtacgccccccccatcgccggcaacatcacctgcatctccaacatcaccggcctgctgctgacccgcgacggcggcgagaacacccgcgacggcggcaacaacaacaccgagaccttccgccccgagggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 212 - DNA, 1995 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcgcaacgtgtgggccacccacgcctgcgtgcccaccgaccccaacccccaggagatggtgctggagaacgtgaccgagaacttcaacatgtggaagaacgacatggccgaccagatgcacgaggacgtgatctccctgtgggaccagtccctgaagccctgcgtgaagctgacccccctgtgcgtgaccctgaactgcaccgacgccaacgccaccgcctccaacaccaacgccaccgcctccaacatcaacgccaccgcctccaagtcctccatcatcgaggagatgaagaactgctccttcaacatcaccaccgagctgcgcgacaagcgcgagaagaagtacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccgacaactccaagaccatcatcgtgcacctgaacgagtccgtgaagatcgagtgcacccgcccctccaacaacacccgcacctccatccgcatcggccccggccagtggttctacgccaccggccaggtgatcggcgacatccgcgaggcccactgcaacatctccgagtccaagtggaacgagaccctgcagcgcgtgtccaagaagctgaaggagtacttccccgacaagaacatcaccttccagccctcctccggcggcgaccccgagatcaccacccactccttcaactgcggcggcgagttcttctactgcaacacctcctccctgttcaaccgcacctacatggccaactccaccgagaccaactccacccgcaccatcaccctgcactgccgcatcaagcagatcatcaacatgtggcaggaggtgggccgcgccatgtacgccccccccatcgccggcaacatcacctgcatctccaacatcaccggcctgctgctgacccgcgacggcggcgagaacacccgcgacggcggcaacaacaacaccgagaccttccgccccgagggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 213 - DNA, 1980 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaccccctgcgtgaagctgacccccctgtgcgtgaccctgaactgcaccgacgccaacgacaccgcctccaactcctccatcatcaagggcatgaacaactccatcgtgggcgagatgaagaactgctccttcaacatcaccaccgagctgcgcgacaagcgcgagaagaagaacgccctgttctacaagctggacatcgtgcagctggacggcaactcctccgagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccgacaacgccaagaccatcatcgtgcacctgaacgagtccgtgaagatcgagtgcacccgcccctccaacaacacccgcacctccatccgcatcggccccggccagtggttctacgccaccggccaggtgatcggcgacatccgcaaggcccactgcaacatctccgagtccaagtggaacgagaccctgcagcgcgtgtccaagaagctgaaggagtacttccccgacaagaacatcaccttccagccctcctccggcggcgaccccgagatcaccacccactccttcaactgcggcggcgagttcttctactgcaacacctcctccctgttcaaccgcacctacatggccaactccaccgacatggccaactccgccgagaccaactccacccgcaccatcaccctgcactgccgcatcaagcagatcatcaacatgtggcaggaggtgggccgcgccatgtacgccccccccatcgccggcaacatcacctgcatctccaacatcaccggcctgctgctgacccgcgacggcggcaactcctccaccgagaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 214 - DNA, 1980 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcgcaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaccccctgcgtgaagctgacccccctgtgcgtgaccctgaactgcaccgacgccaacgacaccgcctccaactcctccatcatcaagggcatgaacaactccatcgtgggcgagatgaagaactgctccttcaacatcaccaccgagctgcgcgacaagcgcgagaagaagaacgccctgttctacaagctggacatcgtgcagctggacggcaactcctccgagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccgacaacgccaagaccatcatcgtgcacctgaacgagtccgtgaagatcgagtgcacccgcccctccaacaacacccgcacctccatccgcatcggccccggccagtggttctacgccaccggccaggtgatcggcgacatccgcaaggcccactgcaacatctccgagtccaagtggaacgagaccctgcagcgcgtgtccaagaagctgaaggagtacttccccgacaagaacatcaccttccagccctcctccggcggcgaccccgagatcaccacccactccttcaactgcggcggcgagttcttctactgcaacacctcctccctgttcaaccgcacctacatggccaactccaccgacatggccaactccgccgagaccaactccacccgcaccatcaccctgcactgccgcatcaagcagatcatcaacatgtggcaggaggtgggccgcgccatgtacgccccccccatcgccggcaacatcacctgcatctccaacatcaccggcctgctgctgacccgcgacggcggcaactcctccaccgagaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 215 - DNA, 1944 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaacaactccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgccaagaccatcatcgtgcacctgaacgagtccgtgaagatcgagtgcacccgccccaacaacaagacccgcacctccatccgcatcggccccggccagtggttctacgccaccggccaggtgatcggcgacatccgcaaggcctactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccctgcactgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 216 - DNA, 1944 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcgcaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaacaactccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgccaagaccatcatcgtgcacctgaacgagtccgtgaagatcgagtgcacccgccccaacaacaagacccgcacctccatccgcatcggccccggccagtggttctacgccaccggccaggtgatcggcgacatccgcaaggcctactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccctgcactgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 217 - DNA, 1953 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgacaagaccatcatcgtgcacctgaacgagtccgtgaagatcgagtgcacccgcccctccaacaagacccgcacctccatccgcatcggccccggccagtggttctacgccaccggccaggtgatcggcgacatccgcgaggcctactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaacatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacgacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 218 - DNA, 1953 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcgcaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgacaagaccatcatcgtgcacctgaacgagtccgtgaagatcgagtgcacccgcccctccaacaagacccgcacctccatccgcatcggccccggccagtggttctacgccaccggccaggtgatcggcgacatccgcgaggcctactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaacatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacgacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 219 - DNA, 1977 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgccaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcatcatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 220 - DNA, 1977 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcgcaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgccaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcatcatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 221 - DNA, 1944 bp, Artificial Sequence
  Description of Artificial Sequence: Synthetic polynucleotide
atgcccatgggcagcctgcagcccctggccaccctgtacctgctgggcatgctggtggctagcgtgctggccgccgagaacctgtgggtgaccgtctactatggcgtgcccgtctggaaggaagccaaaaccacactgttctgcgctagcgacgctaaggcatacgagaaaaaagtgcacaatgtctgggctactcatgcatgcgtgcctaccgatccaaatccccaggagatggtgctgaagaacgtcacagaaaactttaatatgtggaagaacgacatggtggatcagatgcacgaggacgtgatcagcctgtgggatcagtccctgaagccatgcgtgaaactgactcccctgtgcgtcaccctgaactgtactaatgccaccgcttccaacagctccatcattgaggggatgaagaactgttctttcaatatcactaccgagctgcgcgacaagcgagaaaagaaaaatgccctgttttacaaactggacatcgtgcagctggatggcaactctagtcagtatagactgattaactgcaatacaagcgtgatcactcaggcatgtccaaaggtcagtttcgatcctattccaatccactactgcgcacccgccggatatgctatcctgaagtgtaacaacaagaccttcaccggcactgggccttgcaacaacgtgagcaccgtccagtgtacacatggcattaagccagtggtcagcacccagctgctgctgaacggcagcctggcagagggcgaaatcattatccgcagcgagaacatcacaaataatgtgaagactatcatcgtccacctgaacgagagcgtgaagattgaatgcacacggcccaacaacaagaccaggacatccattcgcatcggacctggccagtggttctacgctactggccaggtcatcggggacatcagagaggcctattgtaacatcaatgagtcaaagtggaatgaaactctgcagagggtgagcaagaaactgaaggaatacttccctcacaaaaacatcacctttcagccatcaagcggcggggacctggagattacaactcattctttcaattgcggaggcgaattcttttactgtaacacctcctctctgtttaatcgcacatatatggctaacagtactgatatggcaaactctactgagaccaatagtacacgaactattaccatccattgccggatcaagcagattatcaacatgtggcaggaagtggggcgggccatgtatgctccccctattgcaggaaatattacctgtatcagcaacattaccggcctgctgctgacaagagacgggggaaagaacaatacagagacttttaggcctggcgggggaaacatgaaagataattggcgctccgagctgtacaagtataaagtggtcaagatcgaaccactgggagtggcacctacccgatgtaaacggagagtggtcggaaggcgccgacggagaagggcagtgggaatcggagccgtcttcctgggctttctgggagcagctggcagcacaatgggagcagcctctatgaccctgacagtgcaggctcgaaatctgctgagtgggatcgtgcagcagcagtcaaacctgctgcgagcaccagaggcacagcagcatctgctgaagctgaccgtgtggggcatcaagcagctgcaggccagagtgctggctgtcgaacggtacctgagagatcagcagctgctgggaatctggggatgcagcggaaagctgatttgctgtacaaacgtgccctggaatagttcatggtcaaacaggaatctgagcgagatctgggacaatatgacctggctgcagtgggataaggaaatcagtaactacacacagatcatctatggcctgctggaggaatcacagaaccagcaggagaaaaatgaacaggacctgctggccctggattga

SEQ ID NO: 222 - DNA, 1938 bp, Artificial Sequence
  Description of Artificial Sequence: Synthetic polynucleotide
atgggcagcctgcagcccctggccaccctgtacctgctgggcatgctggtggctagcgtgctggccgccgagaacctgtgggtgaccgtctactatggcgtgcccgtctggaaggaagccaaaaccacactgttctgcgctagcgacgctaaggcatacgagaaagaagtgagaaatgtctgggctactcatgcatgcgtgcctaccgatccaaatccccaggagatggtgctgaagaacgtcacagaaaactttaatatgtggaagaacgacatggtggatcagatgcacgaggacgtgatcagcctgtgggatcagtccctgaagccatgcgtgaaactgactcccctgtgcgtcaccctgaactgtactaatgccaccgcttccaacagctccatcattgaggggatgaagaactgttctttcaatatcactaccgagctgcgcgacaagcgagaaaagaaaaatgccctgttttacaaactggacatcgtgcagctggatggcaactctagtcagtatagactgattaactgcaatacaagcgtgatcactcaggcatgtccaaaggtcagtttcgatcctattccaatccactactgcgcacccgccggatatgctatcctgaagtgtaacaacaagaccttcaccggcactgggccttgcaacaacgtgagcaccgtccagtgtacacatggcattaagccagtggtcagcacccagctgctgctgaacggcagcctggcagagggcgaaatcattatccgcagcgagaacatcacaaataatgtgaagactatcatcgtccacctgaacgagagcgtgaagattgaatgcacacggcccaacaacaagaccaggacatccattcgcatcggacctggccagtggttctacgctactggccaggtcatcggggacatcagagaggcctattgtaacatcaatgagtcaaagtggaatgaaactctgcagagggtgagcaagaaactgaaggaatacttccctcacaaaaacatcacctttcagccatcaagcggcggggacctggagattacaactcattctttcaattgcggaggcgaattcttttactgtaacacctcctctctgtttaatcgcacatatatggctaacagtactgatatggcaaactctactgagaccaatagtacacgaactattaccatccattgccggatcaagcagattatcaacatgtggcaggaagtggggcgggccatgtatgctccccctattgcaggaaatattacctgtatcagcaacattaccggcctgctgctgacaagagacgggggaaagaacaatacagagacttttaggcctggcgggggaaacatgaaagataattggcgctccgagctgtacaagtataaagtggtcaagatcgaaccactgggagtggcacctacccgatgtaaacggagagtggtcggaaggcgccgacggagaagggcagtgggaatcggagccgtcttcctgggctttctgggagcagctggcagcacaatgggagcagcctctatgaccctgacagtgcaggctcgaaatctgctgagtgggatcgtgcagcagcagtcaaacctgctgcgagcaccagaggcacagcagcatctgctgaagctgaccgtgtggggcatcaagcagctgcaggccagagtgctggctgtcgaacggtacctgagagatcagcagctgctgggaatctggggatgcagcggaaagctgatttgctgtacaaacgtgccctggaatagttcatggtcaaacaggaatctgagcgagatctgggacaatatgacctggctgcagtgggataaggaaatcagtaactacacacagatcatctatggcctgctggaggaatcacagaaccagcaggagaaaaatgaacaggacctgctggccctggattga

SEQ ID NO: 223 - DNA, 1956 bp, Artificial Sequence
  Description of Artificial Sequence: Synthetic polynucleotide
atgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgccaagaccatcatcgtgcacctgaacgagtccgtgaagatcgagtgcacccgccccaacaacaagacccgcacctccatccgcatcggccccggccaggccttctacgccaccggccaggtgatcggcgacatccgcgaggcccactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccgctgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 224 - DNA, 1956 bp, Artificial Sequence
  Description of Artificial Sequence: Synthetic polynucleotide
atgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgtgcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgccaagaccatcatcgtgcacctgaacgagtccgtgaagatcgagtgcacccgccccaacaacaagacccgcacctccatccgcatcggccccggccaggccttctacgccaccggccaggtgatcggcgacatccgcgaggcccactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccgctgccgcatcaagcagatcatcaacatgtggcaggaggtgggccgctgcatgtacgccccccccatcgccggcaacatcacctgcatctccaacatcaccggcctgctgctgacccgcgacggcggcaagaacaacaccgacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 225 - DNA, 1956 bp, Artificial Sequence
  Description of Artificial Sequence: Synthetic polynucleotide
atgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgccaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcccactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccgctgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 226 - DNA, 1956 bp, Artificial Sequence
  Description of Artificial Sequence: Synthetic polynucleotide
atgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcgcaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgccaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcccactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccgctgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 227 - DNA, 1977 bp, Artificial Sequence
  Description of Artificial Sequence: Synthetic polynucleotide
atgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcacaacgtgtgggccacccacgcctgcgtgcccaccgaccccaacccccaggagatggtgctgaagaacgtgaccgagaacttcaacatgtgggagaacgacatggtggaccagatgcacgaggacgtgatctccctgtgggaccagtccctgaagccctgcgtgaagctgacccccctgtgcgtgaccctgaactgcaccgacgccaccgcctccaacgccaccgcctccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccgacaacggcaagaccatcatcgtgcacctgaacgagtccgtgaagatcgagtgcacccgcccctccaacaacacccgcacctccatccgcatcggccccggccaggccttctacgccaccggccaggtgatcggcgacatccgcgaggcccactgcaacatctccgagaacaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccgctgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttcgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 228 - DNA, 1977 bp, Artificial Sequence
  Description of Artificial Sequence: Synthetic polynucleotide
atgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcacaacgtgtgggccacccacgcctgcgtgcccaccgaccccaacccccaggagatggtgctgaagaacgtgaccgagaacttcaacatgtgggagaacgacatggtggaccagatgcacgaggacgtgatctccctgtgggaccagtccctgaagccctgcgtgaagctgacccccctgtgcgtgaccctgaactgcaccgacgccaccgcctccaacgccaccgcctccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgtgcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccgacaacggcaagaccatcatcgtgcacctgaacgagtccgtgaagatcgagtgcacccgcccctccaacaacacccgcacctccatccgcatcggccccggccaggccttctacgccaccggccaggtgatcggcgacatccgcgaggcccactgcaacatctccgagaacaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccgctgccgcatcaagcagatcatcaacatgtggcaggaggtgggccgctgcatgtacgccccccccatcgccggcaacatcacctgcatctccaacatcaccggcctgctgctgacccgcgacggcggcaagaacaacaccgagaccttcgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 229 - DNA, 1974 bp, Artificial Sequence
  Description of Artificial Sequence: Synthetic polynucleotide
atgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtgggagaacgacatggtggaccagatgcacgaggacgtgatctccctgtgggaccagtccctgaagccctgcgtgaagctgacccccctgtgcgtgaccctgaactgcaccgacgccaccgcctccaacgccaccgcctccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccgacaacggcaagaccatcatcgtgcacctgaacgagtccgtgaagatcgagtgcacccgcccctccaacaacacccgcacctccatccgcatcggccccggccagtggttctacgccaccggccaggtgatcggcgacatccgcgaggcccactgcaacatctccgagaacaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccgctgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttcgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggac

SEQ ID NO: 230 - DNA, 1977 bp, Artificial Sequence
  Description of Artificial Sequence: Synthetic polynucleotide
atgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcgcaacgtgtgggccacccacgcctgcgtgcccaccgaccccaacccccaggagatggtgctgaagaacgtgaccgagaacttcaacatgtgggagaacgacatggtggaccagatgcacgaggacgtgatctccctgtgggaccagtccctgaagccctgcgtgaagctgacccccctgtgcgtgaccctgaactgcaccgacgccaccgcctccaacgccaccgcctccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccgacaacggcaagaccatcatcgtgcacctgaacgagtccgtgaagatcgagtgcacccgcccctccaacaacacccgcacctccatccgcatcggccccggccagtggttctacgccaccggccaggtgatcggcgacatccgcgaggcccactgcaacatctccgagaacaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccgctgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttcgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 231 - DNA, 1944 bp, Artificial Sequence
  Description of Artificial Sequence: Synthetic polynucleotide
atgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccgacgccaccgcctccaacgccaccgccatcaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgccaagaccatcatcgtgcacctgaacgagtccgtgaagatcgagtgcacccgcccctccaacaacacccgcacctccatccgcatcggccccggccaggccttctacgccaccggccaggtgatcggcgacatccgcgaggcccactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgagaccaactccacccgcatcatcaccatccgctgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttcgagaccttccgccccgagggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 232 - DNA, 1944 bp, Artificial Sequence
  Description of Artificial Sequence: Synthetic polynucleotide
atgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccgacgccaccgcctccaacgccaccgccatcaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgccaagaccatcatcgtgcacctgaacgagtccgtgaagatcgagtgcacccgcccctccaacaacacccgcacctccatccgcatcggccccggccagtggttctacgccaccggccaggtgatcggcgacatccgcgaggcccactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgagaccaactccacccgcatcatcaccatccgctgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttcgagaccttccgccccgagggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 233 - DNA, 1944 bp, Artificial Sequence
  Description of Artificial Sequence: Synthetic polynucleotide
atgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcgcaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccgacgccaccgcctccaacgccaccgccatcaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgccaagaccatcatcgtgcacctgaacgagtccgtgaagatcgagtgcacccgcccctccaacaacacccgcacctccatccgcatcggccccggccagtggttctacgccaccggccaggtgatcggcgacatccgcgaggcccactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgagaccaactccacccgcatcatcaccatccgctgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttcgagaccttccgccccgagggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 234 - protein, 647 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 235 - protein, 658 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 236 - protein, 647 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVHNVWATHACVPTDPNPQEMVLKNVTENFNMWKNDMADQMHEDVISLWDQSLKPCVKLTPLCVTLNCIDANATASNATASNSSIIEGMKNCSFNITTELRDKIEKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRKAHCNISESKWNETLQRVSKKLKEYFPHKNITFQPSSGGDLEITTHSFNCGGEFFYCNTSSLFNRTYMANSTETNSTRTITLHCRIKQIINMWQEVGRAMYAPPIAGNITCISNITGLLLTRDGGNNNTTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 237 - protein, 662 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVHNVWATHACVPTDPNPQEMVLENVTENFNMWKNDMADQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQAFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPEGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 238 - protein, 647 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVCTQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRCMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 239 - protein, 658 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVCTQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRCMYAPPIAGNITCISNITGLLLTRDGGKNNTETFETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 240 - protein, 647 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVHNVWATHACVPTDPNPQEMVLKNVTENFNMWKNDMADQMHEDVISLWDQSLKPCVKLTPLCVTLNCIDANATASNATASNSSIIEGMKNCSFNITTELRDKIEKKNALFYKLDIVQLDGNSSQYRLINCNTSVCTQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRKAHCNISESKWNETLQRVSKKLKEYFPHKNITFQPSSGGDLEITTHSFNCGGEFFYCNTSSLFNRTYMANSTETNSTRTITLHCRIKQIINMWQEVGRCMYAPPIAGNITCISNITGLLLTRDGGNNNTTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 241 - protein, 662 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVHNVWATHACVPTDPNPQEMVLENVTENFNMWKNDMADQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVCTQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQAFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRCMYAPPIAGNITCISNITGLLLTRDGGENTRDGGNNNTETFRPEGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 242 - protein, 647 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 243 - protein, 647 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVRNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 244 - protein, 647 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNGKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 245 - protein, 647 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVRNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNGKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 246 - protein, 660 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQWFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 247 - protein, 660 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVRNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQWFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 248 - protein, 649 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMADQMHEDVISLWDQSLKPCVKLTPLCVTLNCIDANATASNATASNSSIIEGMKNCSFNITTELRDKIEKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQWFYATGQVIGDIRKAHCNISESKWNETLQRVSKKLKEYFPHKNITFQPSSGGDLEITTHSFNCGGEFFYCNTSSLFNRTYMANSTETNSTRTITLHCRIKQIINMWQEVGRAMYAPPIAGNITCISNITGLLLTRDGGNNNTTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 249 - protein, 649 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVRNVWATHACVPTDPNPQEMVLKNVTENFNMWKNDMADQMHEDVISLWDQSLKPCVKLTPLCVTLNCIDANATASNATASNSSIIEGMKNCSFNITTELRDKIEKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQWFYATGQVIGDIRKAHCNISESKWNETLQRVSKKLKEYFPHKNITFQPSSGGDLEITTHSFNCGGEFFYCNTSSLFNRTYMANSTETNSTRTITLHCRIKQIINMWQEVGRAMYAPPIAGNITCISNITGLLLTRDGGNNNTTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 250 - protein, 664 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLENVTENFNMWKNDMADQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQWFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPEGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 251 - protein, 664 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVRNVWATHACVPTDPNPQEMVLENVTENFNMWKNDMADQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQWFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPEGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 252 - protein, 659 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLTPCVKLTPLCVTLNCTDANDTASNSSIIKGMNNSIVGEMKNCSFNITTELRDKREKKNALFYKLDIVQLDGNSSEYRLINCNTSVITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIRIGPGQWFYATGQVIGDIRKAHCNISESKWNETLQRVSKKLKEYFPDKNITFQPSSGGDPEITTHSFNCGGEFFYCNTSSLFNRTYMANSTDMANSAETNSTRTITLHCRIKQIINMWQEVGRAMYAPPIAGNITCISNITGLLLTRDGGNSSTETETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 253 - protein, 659 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVRNVWATHACVPTDPNPQEMVLKNVTENFNMWKNDMVDQMHEDVISLWDQSLTPCVKLTPLCVTLNCTDANDTASNSSIIKGMNNSIVGEMKNCSFNITTELRDKREKKNALFYKLDIVQLDGNSSEYRLINCNTSVITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIRIGPGQWFYATGQVIGDIRKAHCNISESKWNETLQRVSKKLKEYFPDKNITFQPSSGGDPEITTHSFNCGGEFFYCNTSSLFNRTYMANSTDMANSAETNSTRTITLHCRIKQIINMWQEVGRAMYAPPIAGNITCISNITGLLLTRDGGNSSTETETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 254 - protein, 647 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNNSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQWFYATGQVIGDIRKAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 255 - protein, 647 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVRNVWATHACVPTDPNPQEMVLKNVTENFNMWKNDMVDQMHEDVISLWDQSLKPCVKLTPLCVTLNCTNATASNNSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQWFYATGQVIGDIRKAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 256 - protein, 650 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPSNKTRTSIRIGPGQWFYATGQVIGDIREAYCNISESKWNETLQRVSKKLKEYFPHKNITFQPSSGGDLEITTHSFNCGGEFFYCNTSSLFNRTYMANSTDMANSTETNSTRNITIHCRIKQIINMWQEVGRAMYAPPIAGNITCISNITGLLLTRDGGKNDTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 257 - protein, 650 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVRNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPSNKTRTSIRIGPGQWFYATGQVIGDIREAYCNISESKWNETLQRVSKKLKEYFPHKNITFQPSSGGDLEITTHSFNCGGEFFYCNTSSLFNRTYMANSTDMANSTETNSTRNITIHCRIKQIINMWQEVGRAMYAPPIAGNITCISNITGLLLTRDGGKNDTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 258 - protein, 658 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQWFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 259 - protein, 658 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVRNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQWFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 260 - protein, 647 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 261 - protein, 647 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVRNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 262 - protein, 651 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAHCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 263 - protein, 651 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVCTQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAHCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRCMYAPPIAGNITCISNITGLLLTRDGGKNNTDTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 264 - protein, 651 aa, Artificial Sequence
  Description of Artificial Sequence: Synthetic polypeptide
MGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQWFYATGQVIGDIREAHCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 265 - protein, 651 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVRNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQWFYATGQVIGDIREAHCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 266 - protein, 658 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCTDATASNATASNATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISENKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 267 - protein, 658 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCTDATASNATASNATASNSSIIEGMKNCSFNITTELRDKREKKNALFYKLDIVQLDGNSSQYRLINCNTSVCTQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISENKWNETLQRVSKKLKEYFPHKNITFQPSSGGDLEITTHSFNCGGEFFYCNTSSLFNRTYMANSTDMANSTETNSTRTITIRCRIKQIINMWQEVGRCMYAPPIAGNITCISNITGLLLTRDGGKNNTETFETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 268 - protein, 658 aa, Artificial Sequence
  Description of Artificial Sequence: Synthetic polypeptide
MGSLQPLATLYLLGMLVASVLAAENLWVTVYYGVPVWKEAKTTLFCASDAKAYEKKVHNVWATHACVPTDPNPQEMVLKNVTENFNMWENDMVDQMHEDVISLWDQSLKPCVKLTPLCVTLNCTDATASNATASNATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQWFYATGQVIGDIREAHCNISENKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 269 - protein, 658 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVRNVWATHACVPTDPNPQEMVLKNVTENFNMWENDMVDQMHEDVISLWDQSLKPCVKLTPLCVTLNCTDATASNATASNATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQWFYATGQVIGDIREAHCNISENKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 270 - protein, 647 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATAINSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNNAKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRIITIRCRIKQIINMWQEVGRAMYAPPIAGNITCISNITGLLLTRDGGKNNTETFETFRPEGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 271 - protein, 647 aa, Artificial Sequence
  Description of Artificial Sequence: Synthetic polypeptide
MGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTDATASNATAINSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNNAKTIIVHLNESVKIECTRPSNNTRTSIRIGPGQWFYATGQVIGDIREAHCNISESKWNETLQRVSKKLKEYFPHKNITFQPSSGGDLEITTHSFNCGGEFFYCNTSSLFNRTYMANSTETNSTRIITIRCRIKQIINMWQEVGRAMYAPPIAGNITCISNITGLLLTRDGGKNNTETFETFRPEGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 272 - protein, 647 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVRNVWATHACVPTDPNPQEMVLKNVTENFNMWKNDMVDQMHEDVISLWDQSLKPCVKLTPLCVTLNCTDATASNATAINSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNNAKTIIVHLNESVKIECTRPSNNTRTSIRIGPGQWFYATGQVIGDIREAHCNISESKWNETLQRVSKKLKEYFPHKNITFQPSSGGDLEITTHSFNCGGEFFYCNTSSLFNRTYMANSTETNSTRIITIRCRIKQIINMWQEVGRAMYAPPIAGNITCISNITGLLLTRDGGKNNTETFETFRPEGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 273 - protein, 24 aa, Artificial Sequence
  Description of Artificial Sequence: Synthetic peptide
MPMGSLQPLATLYLLGMLVASVLA

SEQ ID NO: 274 - protein, 647 aa, Artificial Sequence; identical to SEQ ID NO: 260
  Description of Artificial Sequence: Synthetic polypeptide

SEQ ID NO: 275 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 276 - protein, 651 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGSGLNDIFEAQKIEWHE

SEQ ID NO: 277 - DNA, 2550 bp, Artificial Sequence
  Description of Artificial Sequence: Synthetic polynucleotide
atgcccatgggcagcctgcagcccctggccaccctgtacctgctgggcatgctggtggctagcgtgctggccgccgagaacctgtgggtgaccgtctactatggcgtgcccgtctggaaggaagccaaaaccacactgttctgcgctagcgacgctaaggcatacgagaaaaaagtgcacaatgtctgggctactcatgcatgcgtgcctaccgatccaaatccccaggagatggtgctgaagaacgtcacagaaaactttaatatgtggaagaacgacatggtggatcagatgcacgaggacgtgatcagcctgtgggatcagtccctgaagccatgcgtgaaactgactcccctgtgcgtcaccctgaactgtactaatgccaccgcttccaacagctccatcattgaggggatgaagaactgttctttcaatatcactaccgagctgcgcgacaagcgagaaaagaaaaatgccctgttttacaaactggacatcgtgcagctggatggcaactctagtcagtatagactgattaactgcaatacaagcgtgatcactcaggcatgtccaaaggtcagtttcgatcctattccaatccactactgcgcacccgccggatatgctatcctgaagtgtaacaacaagaccttcaccggcactgggccttgcaacaacgtgagcaccgtccagtgtacacatggcattaagccagtggtcagcacccagctgctgctgaacggcagcctggcagagggcgaaatcattatccgcagcgagaacatcacaaataatgtgaagactatcatcgtccacctgaacgagagcgtgaagattgaatgcacacggcccaacaacaagaccaggacatccattcgcatcggacctggccagtggttctacgctactggccaggtcatcggggacatcagagaggcctattgtaacatcaatgagtcaaagtggaatgaaactctgcagagggtgagcaagaaactgaaggaatacttccctcacaaaaacatcacctttcagccatcaagcggcggggacctggagattacaactcattctttcaattgcggaggcgaattcttttactgtaacacctcctctctgtttaatcgcacatatatggctaacagtactgatatggcaaactctactgagaccaatagtacacgaactattaccatccattgccggatcaagcagattatcaacatgtggcaggaagtggggcgggccatgtatgctccccctattgcaggaaatattacctgtatcagcaacattaccggcctgctgctgacaagagacgggggaaagaacaatacagagacttttaggcctggcgggggaaacatgaaagataattggcgctccgagctgtacaagtataaagtggtcaagatcgaaccactgggagtggcacctacccgatgtaaacggagagtggtcggaaggcgccgacggagaagggcagtgggaatcggagccgtcttcctgggctttctgggagcagctggcagcacaatgggagcagcctctatgaccctgacagtgcaggctcgaaatctgctgagtgggatcgtgcagcagcagtcaaacctgctgcgagcaccagaggcacagcagcatctgctgaagctgaccgtgtggggcatcaagcagctgcaggccagagtgctggctgtcgaacggtacctgagagatcagcagctgctgggaatctggggatgcagcggaaagctgatttgctgtacaaacgtgccctggaatagttcatggtcaaacaggaatctgagcgagatctgggacaatatgacctggctgcagtgggataaggaaatcagtaactacacacagatcatctatggcctgctggaggaatcacagaaccagcaggagaaaaatgaacaggacctgctggccctggattgactaaagtgggcaagtctgtggaattggtttgacatatcaaactggctgtggtatataaaaatatttataatgatagtaggaggcttaataggattaagaatagtttttgctgtgctttctgtaatacatagagttaggcagggatactcacctttgtcgtttcagacccataccccaaacccaaggggactcgacaggcccgaaagaatcgaagaagaagatggagagcaagacagaggcagatcgacgcgattagtgagcggattcttagctcttgcctgggacgatctgaggagcctgtgcctcttctgctaccaccgattgagagacttcatcttgattgcagcgaggattgtggaacttctgggacacagcagtctcaaggggttgagactggggtgggaaggcctcaagtatctgtggaatctcctggcatattggggtcgggaactaaaaattagtgctattaatttgtttgataccatagcaatagcagtagctgagtggacagatagggttatagaaataggacaaagactttgtagagcttttctccacatacctagaagaatcagacagggcctcgaaagggctttgctataataa

SEQ ID NO: 278 - protein, 847 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDLKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 279 - DNA, 2553 bp, Artificial Sequence
  Description of Artificial Sequence: Synthetic polynucleotide
atgcccatgggcagcctgcagcccctggccaccctgtacctgctgggcatgctggtggctagcgtgctggccgccgagaacctgtgggtgaccgtctactatggcgtgcccgtctggaaggaagccaaaaccacactgttctgcgctagcgacgctaaggcatacgagaaaaaagtgcacaatgtctgggctactcatgcatgcgtgcctaccgatccaaatccccaggagatggtgctgaagaacgtcacagaaaactttaatatgtggaagaacgacatggtggatcagatgcacgaggacgtgatcagcctgtgggatcagtccctgaagccatgcgtgaaactgactcccctgtgcgtcaccctgaactgtactaatgccaccgcttccaacagctccatcattgaggggatgaagaactgttctttcaatatcactaccgagctgcgcgacaagcgagaaaagaaaaatgccctgttttacaaactggacatcgtgcagctggatggcaactctagtcagtatagactgattaactgcaatacaagcgtgatcactcaggcatgtccaaaggtcagtttcgatcctattccaatccactactgcgcacccgccggatatgctatcctgaagtgtaacaacaagaccttcaccggcactgggccttgcaacaacgtgagcaccgtccagtgtacacatggcattaagccagtggtcagcacccagctgctgctgaacggcagcctggcagagggcgaaatcattatccgcagcgagaacatcacaaataatgtgaagactatcatcgtccacctgaacgagagcgtgaagattgaatgcacacggcccaacaacaagaccaggacatccattcgcatcggacctggccagtggttctacgctactggccaggtcatcggggacatcagagaggcctattgtaacatcaatgagtcaaagtggaatgaaactctgcagagggtgagcaagaaactgaaggaatacttccctcacaaaaacatcacctttcagccatcaagcggcggggacctggagattacaactcattctttcaattgcggaggcgaattcttttactgtaacacctcctctctgtttaatcgcacatatatggctaacagtactgatatggcaaactctactgagaccaatagtacacgaactattaccatccattgccggatcaagcagattatcaacatgtggcaggaagtggggcgggccatgtatgctccccctattgcaggaaatattacctgtatcagcaacattaccggcctgctgctgacaagagacgggggaaagaacaatacagagacttttaggcctggcgggggaaacatgaaagataattggcgctccgagctgtacaagtataaagtggtcaagatcgaaccactgggagtggcacctacccgatgtaaacggagagtggtcggaaggcgccgacggagaagggcagtgggaatcggagccgtcttcctgggctttctgggagcagctggcagcacaatgggagcagcctctatgaccctgacagtgcaggctcgaaatctgctgagtgggatcgtgcagcagcagtcaaacctgctgcgagcaccagaggcacagcagcatctgctgaagctgaccgtgtggggcatcaagcagctgcaggccagagtgctggctgtcgaacggtacctgagagatcagcagctgctgggaatctggggatgcagcggaaagctgatttgctgtacaaacgtgccctggaatagttcatggtcaaacaggaatctgagcgagatctgggacaatatgacctggctgcagtgggataaggaaatcagtaactacacacagatcatctatggcctgctggaggaatcacagaaccagcaggagaaaaatgaacaggacctgctggccctggattgactaggcaagtgggcaagtctgtggaattggtttgacatatcaaactggctgtggtatataaaaatatttataatgatagtaggaggcttaataggattaagaatagtttttgctgtgctttctgtaatacatagagttaggcagggatactcacctttgtcgtttcagacccataccccaaacccaaggggactcgacaggcccgaaagaatcgaagaagaagatggagagcaagacagaggcagatcgacgcgattagtgagcggattcttagctcttgcctgggacgatctgaggagcctgtgcctcttctgctaccaccgattgagagacttcatcttgattgcagcgaggattgtggaacttctgggacacagcagtctcaaggggttgagactggggtgggaaggcctcaagtatctgtggaatctcctggcatattggggtcgggaactaaaaattagtgctattaatttgtttgataccatagcaatagcagtagctgagtggacagatagggttatagaaataggacaaagactttgtagagcttttctccacatacctagaagaatcagacagggcctcgaaagggctttgctataataa

SEQ ID NO: 280 - protein, 848 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDLGKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 281 - DNA, 2550 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaagaacgtgaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatcaacgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggattgactaaagtgggcaagtctgtggaattggtttgacatatcaaactggctgtggtatataaaaatatttataatgatagtaggaggcttaataggattaagaatagtttttgctgtgctttctgtaatacatagagttaggcagggatactcacctttgtcgtttcagacccataccccaaacccaaggggactcgacaggcccgaaagaatcgaagaagaagatggagagcaagacagaggcagatcgacgcgattagtgagcggattcttagctcttgcctgggacgatctgaggagcctgtgcctcttctgctaccaccgattgagagacttcatcttgattgcagcgaggattgtggaacttctgggacacagcagtctcaaggggttgagactggggtgggaaggcctcaagtatctgtggaatctcctggcatattggggtcgggaactaaaaattagtgctattaatttgtttgataccatagcaatagcagtagctgagtggacagatagggttatagaaataggacaaagactttgtagagcttttctccacatacctagaagaatcagacagggcctcgaaagggctttgctataataa

SEQ ID NO: 282 - protein, 847 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDLKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 283 - DNA, 2553 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaagaacgtgaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatcaacgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggattgactaggcaagtgggcaagtctgtggaattggtttgacatatcaaactggctgtggtatataaaaatatttataatgatagtaggaggcttaataggattaagaatagtttttgctgtgctttctgtaatacatagagttaggcagggatactcacctttgtcgtttcagacccataccccaaacccaaggggactcgacaggcccgaaagaatcgaagaagaagatggagagcaagacagaggcagatcgacgcgattagtgagcggattcttagctcttgcctgggacgatctgaggagcctgtgcctcttctgctaccaccgattgagagacttcatcttgattgcagcgaggattgtggaacttctgggacacagcagtctcaaggggttgagactggggtgggaaggcctcaagtatctgtggaatctcctggcatattggggtcgggaactaaaaattagtgctattaatttgtttgataccatagcaatagcagtagctgagtggacagatagggttatagaaataggacaaagactttgtagagcttttctccacatacctagaagaatcagacagggcctcgaaagggctttgctataataa

SEQ ID NO: 284 - protein, 848 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDLGKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 285 - protein, 847 aa, Artificial Sequence; identical to SEQ ID NO: 282
  Description of Artificial Sequence: Synthetic polypeptide

SEQ ID NO: 286 - protein, 847 aa, Artificial Sequence; identical to SEQ ID NO: 278
  Description of Artificial Sequence: Synthetic polypeptide

SEQ ID NO: 287 - protein, 848 aa, Artificial Sequence; identical to SEQ ID NO: 284
  Description of Artificial Sequence: Synthetic polypeptide

SEQ ID NO: 288 - protein, 848 aa, Artificial Sequence; identical to SEQ ID NO: 280
  Description of Artificial Sequence: Synthetic polypeptide

SEQ ID NO: 289 - DNA, 2583 bp, Artificial Sequence
  Description of Artificial Sequence: Synthetic polynucleotide
atgagagtgatggggatacagaggaattgtcagcacttattcagatggggaactatgatcttggggatgataataatctgtagtgcagcagaaaacttgtgggtcactgtctactatggggtacctgtgtggaaagacgcagagaccaccttattttgtgcatcagatgctaaagcatatgagacagaaaagcataatgtctgggctacacatgcctgtgtacccacagaccccaacccacaagaaatacatttggaaaatgtgactgaagagtttaacatgtggaaaaataacatggtagagcagatgcatacagatatcatcagtctatgggaccaaagcctaaagccatgtgtaaagttaacccctctctgcgttactctacagtgtaccaatgtcaccaataatatcactgatgacatgaggggagaattaaaaaactgctctttcaatatgaccacagagctaagggataagaaacagaaggtttattcacttttttatagactagatgtagtacaaattaacgagaatcaaggtaataggagtaataatagtaacaaggagtatagattaataaattgtaatacctcagccattacacaggcttgtccaaaggtatcctttgagccaattcccatacattattgtgccccagctggttttgcgatcctaaagtgtaaggataagaagttcaatggaacagggccatgcccaagtgtcagcacagtacaatgcacacatggaatcaagccagtagtatcaactcaactgctgttaaatggcagtctagcagaagaagaggtaatgattagatctgaaaatatcacaaacaatgccaaaaacatactagtacaatttaacacgcctgtgcaaattaattgtaccagacctaacaacaatacaaggaaaagtatacgtataggaccaggacaagcattctatgcaacaggggacataataggggatataagacaagcacattgtactgtcagtaaagcaacatggaatgaaactttgggaaaggtggtcaaacaattaagaaaacactttgggaacaacacaataataagatttgctaattcctcaggaggggatctagaagtcacaacacatagttttaattgtggaggagaatttttctattgtaacacatcaggcctgttcaatagcacttggattagcaataccagcgtgcaggggtcaaatagcacggggtcaaatgacagtataactctcccatgcagaataaagcaaattataaatatgtggcagagaataggacaagcaatgtatgcccctcccatccaaggagtaataagatgtgtatcaaacattacagggctaatattaacaagagatggtgggagtactaatagtacaactgaaaccttcagacctggaggaggagatatgagggacaattggagaagtgaattatataagtataaagtagtaaaaattgaaccactaggagtagcacccaccagggcaaagagaagagtggtggggagagaaaaaagagcagttggaataggagctgtcttccttgggttcttaggagcagcaggaagcactatgggcgcggcgtcaatgacgctgacggtacaggccagaaatttattatctggcatagtgcaacagcaaagcaatttgctgagggctatagaggctcaacaacatctgttgaaactcacggtctggggcattaaacagctccaggcaagggtcctggctgtggaaagatacctaagggatcaacagcttctaggaatttggggctgctctggaaaactcatctgcaccactaatgtgccctggaactctagttggagtaatagaaacctgagtgagatatgggacaacatgacctggctgcaatgggataaagaaattagcaattacacacagataatatatgggctacttgaagaatcgcagaaccagcaggaaaagaatgaacaagacttattggcattggataagtgggcaagtctgtggaattggtttgacatatcaaactggctgtggtatataaaaatatttataatgatagtaggaggcttaataggattaagaatagtttttgctgtgctttctgtaatacatagagttaggcagggatactcacctttgtcgtttcagacccataccccaaacccaaggggactcgacaggcccgaaagaatcgaagaagaagatggagagcaagacagaggcagatcgacgcgattagtgagcggattcttagctcttgcctgggacgatctgaggagcctgtgcctcttctgctaccaccgattgagagacttcatcttgattgcagcgaggattgtggaacttctgggacacagcagtctcaaggggttgagactggggtgggaaggcctcaagtatctgtggaatctcctggcatattggggtcgggaactaaaaattagtgctattaatttgtttgataccatagcaatagcagtagctgagtggacagatagggttatagaaataggacaaagactttgtagagcttttctccacatacctagaagaatcagacagggcctcgaaagggctttgctataa

SEQ ID NO: 290 - protein, 860 aa, Artificial Sequence
  Description of Artificial Sequence: Synthetic polypeptide
MRVMGIQRNCQHLFRWGTMILGMIIICSAAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGREKRAVGIGAVFLGFLGAAGSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 291 - DNA, 2570 bp, Artificial Sequence
  Description of Artificial Sequence: Synthetic polynucleotide
tctagaccaccatgcccatgggcagcctgcagcccctggccaccctgtacctgctgggcatgctggtggctagcgtgctggccgccgagaacctgtgggtgaccgtctactatggcgtgcccgtctggaaggaagccaaaaccacactgttctgcgctagcgacgctaaggcatacgagaaaaaagtgcacaatgtctgggctactcatgcatgcgtgcctaccgatccaaatccccaggagatggtgctgaagaacgtcacagaaaactttaatatgtggaagaacgacatggtggatcagatgcacgaggacgtgatcagcctgtgggatcagtccctgaagccatgcgtgaaactgactcccctgtgcgtcaccctgaactgtactaatgccaccgcttccaacagctccatcattgaggggatgaagaactgttctttcaatatcactaccgagctgcgcgacaagcgagaaaagaaaaatgccctgttttacaaactggacatcgtgcagctggatggcaactctagtcagtatagactgattaactgcaatacaagcgtgatcactcaggcatgtccaaaggtcagtttcgatcctattccaatccactactgcgcacccgccggatatgctatcctgaagtgtaacaacaagaccttcaccggcactgggccttgcaacaacgtgagcaccgtccagtgtacacatggcattaagccagtggtcagcacccagctgctgctgaacggcagcctggcagagggcgaaatcattatccgcagcgagaacatcacaaataatgtgaagactatcatcgtccacctgaacgagagcgtgaagattgaatgcacacggcccaacaacaagaccaggacatccattcgcatcggacctggccagtggttctacgctactggccaggtcatcggggacatcagagaggcctattgtaacatcaatgagtcaaagtggaatgaaactctgcagagggtgagcaagaaactgaaggaatacttccctcacaaaaacatcacctttcagccatcaagcggcggggacctggagattacaactcattctttcaattgcggaggcgaattcttttactgtaacacctcctctctgtttaatcgcacatatatggctaacagtactgatatggcaaactctactgagaccaatagtacacgaactattaccatccattgccggatcaagcagattatcaacatgtggcaggaagtggggcgggccatgtatgctccccctattgcaggaaatattacctgtatcagcaacattaccggcctgctgctgacaagagacgggggaaagaacaatacagagacttttaggcctggcgggggaaacatgaaagataattggcgctccgagctgtacaagtataaagtggtcaagatcgaaccactgggagtggcacctacccgatgtaaacggagagtggtcggaaggcgccgacggagaagggcagtgggaatcggagccgtcttcctgggctttctgggagcagctggcagcacaatgggagcagcctctatgaccctgacagtgcaggctcgaaatctgctgagtgggatcgtgcagcagcagtcaaacctgctgcgagcaccagaggcacagcagcatctgctgaagctgaccgtgtggggcatcaagcagctgcaggccagagtgctggctgtcgaacggtacctgagagatcagcagctgctgggaatctggggatgcagcggaaagctgatttgctgtacaaacgtgccctggaatagttcatggtcaaacaggaatctgagcgagatctgggacaatatgacctggctgcagtgggataaggaaatcagtaactacacacagatcatctatggcctgctggaggaatcacagaaccagcaggagaaaaatgaacaggacctgctggccctggattgactaggcaagtgggcaagtctgtggaattggtttgacatatcaaactggctgtggtatataaaaatatttataatgatagtaggaggcttaataggattaagaatagtttttgctgtgctttctgtaatacatagagttaggcagggatactcacctttgtcgtttcagacccataccccaaacccaaggggactcgacaggcccgaaagaatcgaagaagaagatggagagcaagacagaggcagatcgacgcgattagtgagcggattcttagctcttgcctgggacgatctgaggagcctgtgcctcttctgctaccaccgattgagagacttcatcttgattgcagcgaggattgtggaacttctgggacacagcagtctcaaggggttgagactggggtgggaaggcctcaagtatctgtggaatctcctggcatattggggtcgggaactaaaaattagtgctattaatttgtttgataccatagcaatagcagtagctgagtggacagatagggttatagaaataggacaaagactttgtagagcttttctccacatacctagaagaatcagacagggcctcgaaagggctttgctataataaggatcc

SEQ ID NO: 292 - protein, 848 aa, Artificial Sequence; identical to SEQ ID NO: 280
  Description of Artificial Sequence: Synthetic polypeptide

SEQ ID NO: 293 - DNA, 2567 bp, Artificial Sequence
  Description of Artificial Sequence: Synthetic polynucleotide
tctagaccaccatgcccatgggcagcctgcagcccctggccaccctgtacctgctgggcatgctggtggctagcgtgctggccgccgagaacctgtgggtgaccgtctactatggcgtgcccgtctggaaggaagccaaaaccacactgttctgcgctagcgacgctaaggcatacgagaaaaaagtgcacaatgtctgggctactcatgcatgcgtgcctaccgatccaaatccccaggagatggtgctgaagaacgtcacagaaaactttaatatgtggaagaacgacatggtggatcagatgcacgaggacgtgatcagcctgtgggatcagtccctgaagccatgcgtgaaactgactcccctgtgcgtcaccctgaactgtactaatgccaccgcttccaacagctccatcattgaggggatgaagaactgttctttcaatatcactaccgagctgcgcgacaagcgagaaaagaaaaatgccctgttttacaaactggacatcgtgcagctggatggcaactctagtcagtatagactgattaactgcaatacaagcgtgatcactcaggcatgtccaaaggtcagtttcgatcctattccaatccactactgcgcacccgccggatatgctatcctgaagtgtaacaacaagaccttcaccggcactgggccttgcaacaacgtgagcaccgtccagtgtacacatggcattaagccagtggtcagcacccagctgctgctgaacggcagcctggcagagggcgaaatcattatccgcagcgagaacatcacaaataatgtgaagactatcatcgtccacctgaacgagagcgtgaagattgaatgcacacggcccaacaacaagaccaggacatccattcgcatcggacctggccagtggttctacgctactggccaggtcatcggggacatcagagaggcctattgtaacatcaatgagtcaaagtggaatgaaactctgcagagggtgagcaagaaactgaaggaatacttccctcacaaaaacatcacctttcagccatcaagcggcggggacctggagattacaactcattctttcaattgcggaggcgaattcttttactgtaacacctcctctctgtttaatcgcacatatatggctaacagtactgatatggcaaactctactgagaccaatagtacacgaactattaccatccattgccggatcaagcagattatcaacatgtggcaggaagtggggcgggccatgtatgctccccctattgcaggaaatattacctgtatcagcaacattaccggcctgctgctgacaagagacgggggaaagaacaatacagagacttttaggcctggcgggggaaacatgaaagataattggcgctccgagctgtacaagtataaagtggtcaagatcgaaccactgggagtggcacctacccgatgtaaacggagagtggtcggaaggcgccgacggagaagggcagtgggaatcggagccgtcttcctgggctttctgggagcagctggcagcacaatgggagcagcctctatgaccctgacagtgcaggctcgaaatctgctgagtgggatcgtgcagcagcagtcaaacctgctgcgagcaccagaggcacagcagcatctgctgaagctgaccgtgtggggcatcaagcagctgcaggccagagtgctggctgtcgaacggtacctgagagatcagcagctgctgggaatctggggatgcagcggaaagctgatttgctgtacaaacgtgccctggaatagttcatggtcaaacaggaatctgagcgagatctgggacaatatgacctggctgcagtgggataaggaaatcagtaactacacacagatcatctatggcctgctggaggaatcacagaaccagcaggagaaaaatgaacaggacctgctggccctggattgactaaagtgggcaagtctgtggaattggtttgacatatcaaactggctgtggtatataaaaatatttataatgatagtaggaggcttaataggattaagaatagtttttgctgtgctttctgtaatacatagagttaggcagggatactcacctttgtcgtttcagacccataccccaaacccaaggggactcgacaggcccgaaagaatcgaagaagaagatggagagcaagacagaggcagatcgacgcgattagtgagcggattcttagctcttgcctgggacgatctgaggagcctgtgcctcttctgctaccaccgattgagagacttcatcttgattgcagcgaggattgtggaacttctgggacacagcagtctcaaggggttgagactggggtgggaaggcctcaagtatctgtggaatctcctggcatattggggtcgggaactaaaaattagtgctattaatttgtttgataccatagcaatagcagtagctgagtggacagatagggttatagaaataggacaaagactttgtagagcttttctccacatacctagaagaatcagacagggcctcgaaagggctttgctataataaggatcc

SEQ ID NO: 294 - protein, 847 aa, Artificial Sequence; identical to SEQ ID NO: 278
  Description of Artificial Sequence: Synthetic polypeptide

SEQ ID NO: 295 - protein, 848 aa, Artificial Sequence; identical to SEQ ID NO: 280
  Description of Artificial Sequence: Synthetic polypeptide

SEQ ID NO: 296 - protein, 847 aa, Artificial Sequence; identical to SEQ ID NO: 278
  Description of Artificial Sequence: Synthetic polypeptide

SEQ ID NO: 297 - DNA, 1962 bp, Artificial Sequence
  Description of Artificial Sequence: Synthetic polynucleotide
atgcccatgggcagcctgcagcccctggccaccctgtacctgctgggcatgctggtggctagcgtgctggccgccgagaacctgtgggtgaccgtctactatggcgtgcccgtctggaaggaagccaaaaccacactgttctgcgctagcgacgctaaggcatacgagaaaaaagtgcacaatgtctgggctactcatgcatgcgtgcctaccgatccaaatccccaggagatggtgctgaagaacgtcacagaaaactttaatatgtggaagaacgacatggtggatcagatgcacgaggacgtgatcagcctgtgggatcagtccctgaagccatgcgtgaaactgactcccctgtgcgtcaccctgaactgtactaatgccaccgcttccaacagctccatcattgaggggatgaagaactgttctttcaatatcactaccgagctgcgcgacaagcgagaaaagaaaaatgccctgttttacaaactggacatcgtgcagctggatggcaactctagtcagtatagactgattaactgcaatacaagcgtgatcactcaggcatgtccaaaggtcagtttcgatcctattccaatccactactgcgcacccgccggatatgctatcctgaagtgtaacaacaagaccttcaccggcactgggccttgcaacaacgtgagcaccgtccagtgtacacatggcattaagccagtggtcagcacccagctgctgctgaacggcagcctggcagagggcgaaatcattatccgcagcgagaacatcacaaataatgtgaagactatcatcgtccacctgaacgagagcgtgaagattgaatgcacacggcccaacaacaagaccaggacatccattcgcatcggacctggccagtggttctacgctactggccaggtcatcggggacatcagagaggcctattgtaacatcaatgagtcaaagtggaatgaaactctgcagagggtgagcaagaaactgaaggaatacttccctcacaaaaacatcacctttcagccatcaagcggcggggacctggagattacaactcattctttcaattgcggaggcgaattcttttactgtaacacctcctctctgtttaatcgcacatatatggctaacagtactgatatggcaaactctactgagaccaatagtacacgaactattaccatccattgccggatcaagcagattatcaacatgtggcaggaagtggggcgggccatgtatgctccccctattgcaggaaatattacctgtatcagcaacattaccggcctgctgctgacaagagacgggggaaagaacaatacagagacttttaggcctggcgggggaaacatgaaagataattggcgctccgagctgtacaagtataaagtggtcaagatcgaaccactgggagtggcacctacccgatgtaaacggagagtggtcggaaggcgccgacggagaagggcagtgggaatcggagccgtcttcctgggctttctgggagcagctggcagcacaatgggagcagcctctatgaccctgacagtgcaggctcgaaatctgctgagtgggatcgtgcagcagcagtcaaacctgctgcgagcaccagaggcacagcagcatctgctgaagctgaccgtgtggggcatcaagcagctgcaggccagagtgctggctgtcgaacggtacctgagagatcagcagctgctgggaatctggggatgcagcggaaagctgatttgctgtacaaacgtgccctggaatagttcatggtcaaacaggaatctgagcgagatctgggacaatatgacctggctgcagtgggataaggaaatcagtaactacacacagatcatctatggcctgctggaggaatcacagaaccagcaggagaaaaatgaacaggacctgctggccctggatctgcctagcaccggatgatga

SEQ ID NO: 298 - DNA, 1992 bp, Artificial Sequence
  Description of Artificial Sequence: Synthetic polynucleotide
atgcccatgggcagcctgcagcccctggccaccctgtacctgctgggcatgctggtggctagcgtgctggccggcgggggcgggggcggcgggggcgggggcggcgggggcgggggcgccgagaacctgtgggtgaccgtctactatggcgtgcccgtctggaaggaagccaaaaccacactgttctgcgctagcgacgctaaggcatacgagaaaaaagtgcacaatgtctgggctactcatgcatgcgtgcctaccgatccaaatccccaggagatggtgctgaagaacgtcacagaaaactttaatatgtggaagaacgacatggtggatcagatgcacgaggacgtgatcagcctgtgggatcagtccctgaagccatgcgtgaaactgactcccctgtgcgtcaccctgaactgtactaatgccaccgcttccaacagctccatcattgaggggatgaagaactgttctttcaatatcactaccgagctgcgcgacaagcgagaaaagaaaaatgccctgttttacaaactggacatcgtgcagctggatggcaactctagtcagtatagactgattaactgcaatacaagcgtgatcactcaggcatgtccaaaggtcagtttcgatcctattccaatccactactgcgcacccgccggatatgctatcctgaagtgtaacaacaagaccttcaccggcactgggccttgcaacaacgtgagcaccgtccagtgtacacatggcattaagccagtggtcagcacccagctgctgctgaacggcagcctggcagagggcgaaatcattatccgcagcgagaacatcacaaataatgtgaagactatcatcgtccacctgaacgagagcgtgaagattgaatgcacacggcccaacaacaagaccaggacatccattcgcatcggacctggccagtggttctacgctactggccaggtcatcggggacatcagagaggcctattgtaacatcaatgagtcaaagtggaatgaaactctgcagagggtgagcaagaaactgaaggaatacttccctcacaaaaacatcacctttcagccatcaagcggcggggacctggagattacaactcattctttcaattgcggaggcgaattcttttactgtaacacctcctctctgtttaatcgcacatatatggctaacagtactgatatggcaaactctactgagaccaatagtacacgaactattaccatccattgccggatcaagcagattatcaacatgtggcaggaagtggggcgggccatgtatgctccccctattgcaggaaatattacctgtatcagcaacattaccggcctgctgctgacaagagacgggggaaagaacaatacagagacttttaggcctggcgggggaaacatgaaagataattggcgctccgagctgtacaagtataaagtggtcaagatcgaaccactgggagtggcacctacccgatgtaaacggagagtggtcggaaggcgccgacggagaagggcagtgggaatcggagccgtcttcctgggctttctgggagcagctggcagcacaatgggagcagcctctatgaccctgacagtgcaggctcgaaatctgctgagtgggatcgtgcagcagcagtcaaacctgctgcgagcaccagaggcacagcagcatctgctgaagctgaccgtgtggggcatcaagcagctgcaggccagagtgctggctgtcgaacggtacctgagagatcagcagctgctgggaatctggggatgcagcggaaagctgatttgctgtacaaacgtgccctggaatagttcatggtcaaacaggaatctgagcgagatctgggacaatatgacctggctgcagtgggataaggaaatcagtaactacacacagatcatctatggcctgctggaggaatcacagaaccagcaggagaaaaatgaacaggacctgctggccctggattgatga

SEQ ID NO: 299 - DNA, 1989 bp, Artificial Sequence
  Description of Artificial Sequence: Synthetic polynucleotide
atgcccatgggctccctgcagcccctggccaccctgtacctgctgggcatgctggtggcctccgtgctggccggcgggggcgggggcggcgggggcgggggcggcgggggcgggggcgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaagaacgtgaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatcaacgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 300 - protein, 662 aa, Artificial Sequence
  Description of Artificial Sequence: Synthetic polypeptide
MPMGSLQPLATLYLLGMLVASVLAGGGGGGGGGGGGGGGAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 301 - DNA, 1959 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaagaacgtgaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatcaacgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggacctgcctagcaccggatag

SEQ ID NO: 302 - protein, 652 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDLPSTG

SEQ ID NO: 303 - protein, 7 aa, Artificial Sequence
  Description of Artificial Sequence: Synthetic peptide
  MOD_RES (3)..(3): Any amino acid
  MOD_RES (6)..(7): Any amino acid
LPXTGXX

SEQ ID NO: 304 - protein, 8 aa, Artificial Sequence
  Description of Artificial Sequence: Synthetic peptide
  MOD_RES (6)..(8): Any amino acid
GGGGGXXX

SEQ ID NO: 305 - protein, 12 aa, Artificial Sequence
  Description of Artificial Sequence: Synthetic peptide
  MOD_RES (3)..(3): Any amino acid
  MOD_RES (10)..(12): Any amino acid
LPXTGGGGGXXX

SEQ ID NO: 306 - protein, 10 aa, Artificial Sequence
  Description of Artificial Sequence: Synthetic peptide
  MOD_RES (1)..(3): Any amino acid
  MOD_RES (6)..(6): Any amino acid
  MOD_RES (9)..(10): Any amino acid
XXXLPXTGXX

SEQ ID NO: 307 - protein, 5 aa, Artificial Sequence
  Description of Artificial Sequence: Synthetic peptide
GGGGG

SEQ ID NO: 308 - protein, 12 aa, Artificial Sequence
  Description of Artificial Sequence: Synthetic peptide
  MOD_RES (1)..(3): Any amino acid
  MOD_RES (6)..(6): Any amino acid
XXXLPXTGGGGG

SEQ ID NO: 309 - protein, 5 aa, Artificial Sequence
  Description of Artificial Sequence: Synthetic peptide
GGGSG

SEQ ID NO: 310 - protein, 815 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGGSGDIIKLLNEQVNKEMNSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 311 - DNA, 2451 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgtgaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatcaacgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggacggcggcggctccggcgacatcatcaagctgctgaacgagcaggtgaacaaggagatgaactcctccaacctgtacatgtccatgtcctcctggtgctacacccactccctggacggcgccggcctgttcctgttcgaccacgccgccgaggagtacgagcacgccaagaagctgatcatcttcctgaacgagaacaacgtgcccgtgcagctgacctccatctccgcccccgagcacaagttcgagggcctgacccagatcttccagaaggcctacgagcacgagcagcacatctccgagtccatcaacaacatcgtggaccacgccatcaagtccaaggaccacgccaccttcaacttcctgcagtggtacgtggccgagcagcacgaggaggaggtgctgttcaaggacatcctggacaagatcgagctgatcggcaacgagaaccacggcctgtacctggccgaccagtacgtgaagggcatcgccaagtcccgcaagtcctgataa

SEQ ID NO: 312 - protein, 815 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGGSGDIIKLLNEQVNKEMNSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 313 - DNA, 2451 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaagaacgtgaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatcaacgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggacggcggcggctccggcgacatcatcaagctgctgaacgagcaggtgaacaaggagatgaactcctccaacctgtacatgtccatgtcctcctggtgctacacccactccctggacggcgccggcctgttcctgttcgaccacgccgccgaggagtacgagcacgccaagaagctgatcatcttcctgaacgagaacaacgtgcccgtgcagctgacctccatctccgcccccgagcacaagttcgagggcctgacccagatcttccagaaggcctacgagcacgagcagcacatctccgagtccatcaacaacatcgtggaccacgccatcaagtccaaggaccacgccaccttcaacttcctgcagtggtacgtggccgagcagcacgaggaggaggtgctgttcaaggacatcctggacaagatcgagctgatcggcaacgagaaccacggcctgtacctggccgaccagtacgtgaagggcatcgccaagtcccgcaagtcctagtaa

SEQ ID NO: 314 - protein, 96 aa, Homo sapiens
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYC

SEQ ID NO: 315 - protein, 96 aa, Artificial Sequence
  Description of Artificial Sequence: Synthetic polypeptide
QVQLVQSGAEVKKPGASVTVSCQASGYTFTNYYVHWVRQAPGQGLQLMGWIDPSWGRTNYAQNFQGRITMTRDTSTSTVYMEMRSLRSEDTAVYYC

SEQ ID NO: 316 - protein, 96 aa, Artificial Sequence
  Description of Artificial Sequence: Synthetic polypeptide
QVRLLQYGGGVKRPGASMTISCVASGYNFNDYYIHWVRQAPGQGLELMGWIDPSGGRTDYAGAFGDRVSMYRDKSMNTLYMDLRSLRSGDTAMYYC

SEQ ID NO: 317 - protein, 96 aa, Artificial Sequence
  Description of Artificial Sequence: Synthetic polypeptide
QVRLAQYGGGVKRLGATMTLSCVASGYTFNDYYIHWVRQAPGQGFELLGYIDPANGRPDYAGALRERLSFYRDKSMETLYMDLRSLRYDDTAMYYC

SEQ ID NO: 318 - protein, 96 aa, Artificial Sequence
  Description of Artificial Sequence: Synthetic polypeptide
QVQLEQSGTAVRKPGASVTLSCQASGYNFVKYIIHWVRQKPGLGFEWVGMIDPYRGRPWSAHKFQGRLSLSRDTSMEILYMTLTSLKSDDTATYFC

SEQ ID NO: 319 - protein, 95 aa, Artificial Sequence
  Description of Artificial Sequence: Synthetic polypeptide
QGQLVQSGGGLKKPGTSVTISCLASEYTFNEFVIHWIRQAPGQGPLWLGLIKRSGRLMTAYNFQDRLSLRRDRSTGTVFMELRGLRPDDTAVYYC

SEQ ID NO: 320 - protein, 96 aa, Homo sapiens
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYC

SEQ ID NO: 321 - protein, 96 aa, Artificial Sequence
  Description of Artificial Sequence: Synthetic polypeptide
QVQLVQSGGQMKKPGESMRISCRASGYEFIDCTLNWIRLAPGKRPEWMGWLKPRGGAVNYARPLQGRVTMTRDVYSDTAFLELRSLTVDDTAVYFC

SEQ ID NO: 322 - protein, 105 aa, Artificial Sequence
  Description of Artificial Sequence: Synthetic polypeptide
QVQLVQSGAAVRKPGASVTVSCKFAEDDDYSPYWVNPAPEHFIHFLRQAPGQQLEWLAWMNPTNGAVNYAWYLNGRVTATRDRSMTTAFLEVKSLRSDDTAVYYC

SEQ ID NO: 323 - protein, 98 aa, Artificial Sequence
  Description of Artificial Sequence: Synthetic polypeptide
QVQLVQSGSGVKKPGASVRVSCWTSEDIFERTELIHWVRQAPGQGLEWIGWVKTVTGAVNFGSPDFRQRVSLTRDRDLFTAHMDIRGLTQGDTATYFC

SEQ ID NO: 324 - protein, 98 aa, Homo sapiens
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR

SEQ ID NO: 325 - protein, 98 aa, Homo sapiens; identical to SEQ ID NO: 324

SEQ ID NO: 326 - protein, 63 aa, Artificial Sequence
  Description of Artificial Sequence: Synthetic polypeptide
WVRQAPGQGLEWMGMINPSGGSTSYAQKFQGRVTMTRDTSTSTVYMYLSSLRSEDTAVYYCVR

SEQ ID NO: 327 - protein, 63 aa, Artificial Sequence
  Description of Artificial Sequence: Synthetic polypeptide
WVRQAPGQGLEWMGMINPSGGRTSYPYKFQGRVTMTRDTSTSTVYMEVSSLRSEDTAVYYCVR

SEQ ID NO: 328 - protein, 63 aa, Artificial Sequence
  Description of Artificial Sequence: Synthetic polypeptide
WVRQAPGQGLEWMGMIDPSGGRTSYAQKFQGRVTMTRDTSTSTVYMELSSLRSEDTAVHYCAR

SEQ ID NO: 329 - protein, 63 aa, Artificial Sequence
  Description of Artificial Sequence: Synthetic polypeptide
WVRQAPGQGLEWMGMIDPSVGRTTYAEKFQGRVTMTRDTSTSTVYMDLSSLRSEHTAVYYCAR

SEQ ID NO: 330 - protein, 63 aa, Artificial Sequence
  Description of Artificial Sequence: Synthetic polypeptide
WVRQAPGQGLEWMGMIDPSVGRTTYAEKFQGRVTMTRDTSTSTVYMDLSSLRSEDTAVYYCAR

SEQ ID NO: 331 - protein, 63 aa, Artificial Sequence; identical to SEQ ID NO: 330
  Description of Artificial Sequence: Synthetic polypeptide

SEQ ID NO: 332 - protein, 63 aa, Artificial Sequence
  Description of Artificial Sequence: Synthetic polypeptide
WVRQAPGQGLEWMGMINPRGGSTTYAQRFQGRVTMTRDTSTSIVYMELSRLRSEDTAVYYCVR

SEQ ID NO: 333 - protein, 63 aa, Artificial Sequence
  Description of Artificial Sequence: Synthetic polypeptide
WVRQAPGQGLEWMGMINPSGGRTSSPYKFQGRLTMTRDTSTSTVYMDLSSLRPDDTAVYYCVR

SEQ ID NO: 334 - protein, 63 aa, Artificial Sequence
  Description of Artificial Sequence: Synthetic polypeptide
WVRQAPGQGLEWMGMVNPSGGRTSYPHKFQGRVTMTRDTSTSTVYMGLSSLRSEDTAVYYCAR

SEQ ID NO: 335 - protein, 63 aa, Artificial Sequence
  Description of Artificial Sequence: Synthetic polypeptide
WVRQAPGAGLEWMGMINPSGGRTTYPQKFQGRVTMTRDTSTSTVHMKLSSLRSQDTAVYYCAR

SEQ ID NO: 336 - protein, 63 aa, Artificial Sequence
  Description of Artificial Sequence: Synthetic polypeptide
WVRQAPGAGLEWMGMINPSGGRTTYPQKFQGRVTMTRDTSTSTVYMKLSSLRSQDTAVYYCAR

SEQ ID NO: 337 - protein, 63 aa, Artificial Sequence; identical to SEQ ID NO: 336
  Description of Artificial Sequence: Synthetic polypeptide

SEQ ID NO: 338 - protein, 63 aa, Artificial Sequence
  Description of Artificial Sequence: Synthetic polypeptide
WVRQAPGQGLEWMGMIDPSGGRTSYAPKFQGRLTMTRDTSTDTLYMQLNSLRSEDTAVYYCAR

SEQ ID NO: 339 - protein, 63 aa, Artificial Sequence
  Description of Artificial Sequence: Synthetic polypeptide
WVRQAPGQGLEWMGMIDPSYGRTSYAQKFQGRVTMTRDTSTSTVYMELSSLRSEDTAVFYCAR

SEQ ID NO: 340 - protein, 63 aa, Artificial Sequence; identical to SEQ ID NO: 339
  Description of Artificial Sequence: Synthetic polypeptide

SEQ ID NO: 341 - protein, 63 aa, Artificial Sequence; identical to SEQ ID NO: 330
  Description of Artificial Sequence: Synthetic polypeptide

SEQ ID NO: 342 - protein, 63 aa, Artificial Sequence
  Description of Artificial Sequence: Synthetic polypeptide
WVRQAPGQGLEWMGMLDPSGGRTSYPQKFQGRVTMTRDTSTSTVYMYLSSLRSEDTAVYYCVR

SEQ ID NO: 343 - protein, 63 aa, Artificial Sequence
  Description of Artificial Sequence: Synthetic polypeptide
WVRQAPGQRLEWMGLINPSGGRTSYPHQFQGRVTMTRDTSTSTVYMYLSSLRAEDTAVYYCVR

SEQ ID NO: 344 - protein, 63 aa, Artificial Sequence
  Description of Artificial Sequence: Synthetic polypeptide
WVRQAPGQGLEWMGMLDPSGGRTSHPHKFQGRVTLTRDTSTSTVYMYLSSLRSEDTAVYYCVR

SEQ ID NO: 345 - protein, 63 aa, Artificial Sequence; identical to SEQ ID NO: 333
  Description of Artificial Sequence: Synthetic polypeptide

SEQ ID NO: 346 - protein, 63 aa, Artificial Sequence
  Description of Artificial Sequence: Synthetic polypeptide
WVRQAPGQGLEWMGMIDPSGGRPSYAQKFQGRVSMTRDTSTSTVYMELSSLRSEDTALYYCVR

SEQ ID NO: 347 - protein, 63 aa, Artificial Sequence; identical to SEQ ID NO: 338
  Description of Artificial Sequence: Synthetic polypeptide

SEQ ID NO: 348 - protein, 63 aa, Artificial Sequence
  Description of Artificial Sequence: Synthetic polypeptide
WVRQAPGQGLKWVGMLDPSGGRTTLAHTFQGRVTMTRDTSTSTVYMELNSLRSEDTAVYYCAR

SEQ ID NO: 349 - protein, 58 aa, Artificial Sequence
  Description of Artificial Sequence: Synthetic polypeptide
PGQGLKWVGMLDPSGGRTTLAHTFQGRVTMTRDTSTSTVYMELNSLRSEDTAVYYCAR

SEQ ID NO: 350 - protein, 63 aa, Artificial Sequence; identical to SEQ ID NO: 348
  Description of Artificial Sequence: Synthetic polypeptide

SEQ ID NO: 351 - protein, 63 aa, Artificial Sequence
  Description of Artificial Sequence: Synthetic polypeptide
WVRQAPGQGLEWVGMIDPSVGRTTLPHKFQGRVTMTRDTSTSTVYMKLSTLRSEDTAVYFCAR

SEQ ID NO: 352 - protein, 62 aa, Artificial Sequence
  Description of Artificial Sequence: Synthetic polypeptide
VRQAPGQRLELMGMIDPSRGRTDYAQKFQGRVTMSRDTSTSTLYMELRSLRPDDTALYYCVR

SEQ ID NO: 353 - protein, 63 aa, Artificial Sequence
  Description of Artificial Sequence: Synthetic polypeptide
WVRQAPGQGLDSMGWIDPSVGRTSYSYKFRDRISMFRDTSTNTVYMELRSLRSDDTAVYYCVR

SEQ ID NO: 354 - protein, 63 aa, Artificial Sequence
  Description of Artificial Sequence: Synthetic polypeptide
WVRQAPGQRLEWMGMIDPSVGRPTVAGNFQGRVTLTRDRSTDTVYMDLSSLRSEDTAVYYCAR

SEQ ID NO: 355 - protein, 63 aa, Artificial Sequence
  Description of Artificial Sequence: Synthetic polypeptide
WVRQAPGQGLEWMGMIDPSVGRPTRAGKFQGRVTMTRDRSTSTVYMDLSSLRSEDTAMYYCAR

SEQ ID NO: 356 - protein, 63 aa, Artificial Sequence
  Description of Artificial Sequence: Synthetic polypeptide
WVRQAPGQGLEWMGMIDPSVGRPTRAGKFQGRVTMTRDRSTSTVYMDLSSLKSEDTAVYYCAR

SEQ ID NO: 357 - protein, 63 aa, Artificial Sequence
  Description of Artificial Sequence: Synthetic polypeptide
WVRQAPGQGPEWMGMIDPSFGRPTRPGRFQDRVTLTRDKSTSTVYMDLSSLRPEDTAVYYCAR

SEQ ID NO: 358 - protein, 63 aa, Artificial Sequence
  Description of Artificial Sequence: Synthetic polypeptide
WVRQAPGQRLEWMGMIDPSVGRPSRPYKFQDRVTMTRDRFTNTVYMDLSSLRSEDTAVYYCAR

SEQ ID NO: 359 - protein, 63 aa, Artificial Sequence
  Description of Artificial Sequence: Synthetic polypeptide
WVRQAPGQGFECMGMLDPSGGRTDYSHKFQGRVTMTRDTSTSTVYMSLRSLKSEDTAVYYCVR

SEQ ID NO: 360 - protein, 63 aa, Artificial Sequence; identical to SEQ ID NO: 359
  Description of Artificial Sequence: Synthetic polypeptide

SEQ ID NO: 361 - protein, 63 aa, Artificial Sequence; identical to SEQ ID NO: 359
  Description of Artificial Sequence: Synthetic polypeptide

SEQ ID NO: 362 - protein, 98 aa, Artificial Sequence
  Description of Artificial Sequence: Synthetic polypeptide
QVQLVQSGAEVKKPGASVTVSCQASGYTFTNYYVHWVRQAPGQGLQLMGWIDPSWGRTNYAQNFQGRITMTRDTSTSTVYMEMRSLRSEDTAVYYCAR

SEQ ID NO: 363 - protein, 98 aa, Artificial Sequence
  Description of Artificial Sequence: Synthetic polypeptide
QVQLVQSGAAVKRPGASVTISCRASGYTFTTYYIHWVRQAPGQRLELMGMIDPSRGRTDYAQKFQGRVTMSRDTSTSTLYMELRSLRPDDTALYYCVR

SEQ ID NO: 364 - protein, 122 aa, Artificial Sequence
  Description of Artificial Sequence: Synthetic polypeptide
QVQLVQSGAEVRKPGASVTVSCKASGYTFNNFYVHWVRQAPGQGLECMGWIDPSVGRINYAQKFQGRVTMTRDRSTSTVYMGLSSLRSEDTAIYYCVRDVGTEGSLLHFDHWGQGTLVIVSA

SEQ ID NO: 365 - protein, 122 aa, Artificial Sequence
  Description of Artificial Sequence: Synthetic polypeptide
QVQLVQSGTEVRKPGASVTISCKASGYTFNNFYVHWVRQAPGQGLECMGWIDPSVGRISYGQKFQGRVTMTRDRSTSTVYMGLSSLRSEDTAMYYCVRDVGTEGSLLHFDHWGQGTLVIVSA

SEQ ID NO: 366 - protein, 122 aa, Artificial Sequence
  Description of Artificial Sequence: Synthetic polypeptide
QVQLVQSGAAVKKPGASVRVSCKASGYTFTSSHIHWVRQAPGQGPEWMGMIDPSVGRPTTAGKFQGRVTMTRDRYTSTAYMDLSSLRSEDTAVYYCARSVETTGSLLYFDYWGQGTLITVSS

SEQ ID NO: 367 - protein, 63 aa, Artificial Sequence
  Description of Artificial Sequence: Synthetic polypeptide
WVRQAPGQGLELMGWIDPSVGRINYGQKFEGRVTMTRDRSTSTVYMGLSSLKSEDTAVYYCVR

SEQ ID NO: 368 - protein, 63 aa, Artificial Sequence
  Description of Artificial Sequence: Synthetic polypeptide
WVRQAPGQGLELMGWIDPSVGRINYGQKFQGRVTMTRDRSTSTVYMGLSSLRSEDTAIYYCVR

SEQ ID NO: 369 - protein, 63 aa, Artificial Sequence; identical to SEQ ID NO: 368
  Description of Artificial Sequence: Synthetic polypeptide

SEQ ID NO: 370 - protein, 63 aa, Artificial Sequence
  Description of Artificial Sequence: Synthetic polypeptide
WVRQAPGQRLELMGWIDPYRGRTDYAQKFQDRVSMYRDTSTNTLYMDLRSLRPDDTALYYCVR

SEQ ID NO: 371 - protein, 63 aa, Artificial Sequence
  Description of Artificial Sequence: Synthetic polypeptide
WVRQAPGQGLELMGWIDPSGGRTDYSQAFQGRISMFRDTSTSTVYMELRSLRSGDTAMYYCVR

SEQ ID NO: 372 - protein, 98 aa, Artificial Sequence
  Description of Artificial Sequence: Synthetic polypeptide
QVQLVQSGAAVKKPGASVRVSCKASGYTFTSSHIHWVRQAPGQALEWLGMIDPRFGRPTRPQKFQGRVTLTRDTYTTTVYMSLSSLTPEDTAVYYCAR

SEQ ID NO: 373 - protein, 98 aa, Artificial Sequence
  Description of Artificial Sequence: Synthetic polypeptide
QVQLVQSGAAVKRPGASVTISCRASGYTFTTYYIHWVRQAPGQGLELMGWINPRGGRTDYSYRFEDRVSMYRDTSMSIVYMDLRNLKSADTAVYYCVR

SEQ ID NO: 374 - protein, 98 aa, Artificial Sequence
  Description of Artificial Sequence: Synthetic polypeptide
QVQLVQSGAAVKKPGASVRVSCKASGYTFTSSHIHWVRQAPGQGPEWMGMVDPRFGRPTYAQKFQGRVAMTRDIYTSTVYMDLRSLKSEDTAIYFCVR

SEQ ID NO: 375 - protein, 98 aa, Artificial Sequence
  Description of Artificial Sequence: Synthetic polypeptide
QVRLLQYGGGVKRPGASMTISCVASGYNFNDYYIHWVRQAPGQGLELMGWIDPSGGRTDYAGAFGDRVSMYRDKSMNTLYMDLRSLRSGDTAMYYCVR

SEQ ID NO: 376 - protein, 98 aa, Artificial Sequence
  Description of Artificial Sequence: Synthetic polypeptide
QVQLVQSGATVKKPRASVTLSCRTSGYNFIDYFIHWVRRAPGQRLEVMGYIDPSRGRPDYAPNFRDRVSLYRDTSMSIVYLDLRDLTPDDTAIYYCVR

SEQ ID NO: 377 - protein, 98 aa, Artificial Sequence
  Description of Artificial Sequence: Synthetic polypeptide
QVQLVQSGGTVKSPGTSVTLSCKTSGYNFIDYYIHWVRRAPGQRPELMGYIDPSHGRPDYEGKFRDRISLYRDTSTSVVYMDVRGLRLDDTALYYCVR

SEQ ID NO: 378 - protein, 98 aa, Artificial Sequence
  Description of Artificial Sequence: Synthetic polypeptide
QVRLAQYGGGVKRLGATMTLSCVASGYTFNDYYIHWVRQAPGQGFELLGYIDPANGRPDYAGALRERLSFYRDKSMETLYMDLRSLRYDDTAMYYCVR

SEQ ID NO: 379 - protein, 98 aa, Artificial Sequence
  Description of Artificial Sequence: Synthetic polypeptide
QVQLVQSGGGVKRPGSTTTISCVASGYSFNDYYIHWVRQAPGQGLEVLGFIDPSNGRTNYAGAFGDRFSMYRDKSMETLYMDLRNLRSDDTAMYYCVR

SEQ ID NO: 380 - protein, 98 aa, Artificial Sequence
  Description of Artificial Sequence: Synthetic polypeptide
QVQLEQSGTAVRKPGASVTLSCQASGYNFVKYIIHWVRQKPGLGFEWVGMIDPYRGRPWSAHKFQGRLSLSRDTSMEILYMTLTSLKSDDTATYFCAR

SEQ ID NO: 381 - protein, 97 aa, Artificial Sequence
  Description of Artificial Sequence: Synthetic polypeptide
QGQLVQSGGGLKKPGTSVTISCLASEYTFNEFVIHWIRQAPGQGPLWLGLIKRSGRLMTAYNFQDRLSLRRDRSTGTVFMELRGLRPDDTAVYYCAR

SEQ ID NO: 382 - protein, 98 aa, Homo sapiens
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCAR

SEQ ID NO: 383 - protein, 98 aa, Artificial Sequence
  Description of Artificial Sequence: Synthetic polypeptide
QVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTR

SEQ ID NO: 384 - protein, 107 aa, Artificial Sequence
  Description of Artificial Sequence: Synthetic polypeptide
QVQLVQSGAAVRKPGASVTVSCKFAEDDDYSPYWVNPAPEHFIHFLRQAPGQQLEWLAWMNPTNGAVNYAWYLNGRVTATRDRSMTTAFLEVKSLRSDDTAVYYCAR

SEQ ID NO: 385 - protein, 100 aa, Artificial Sequence
  Description of Artificial Sequence: Synthetic polypeptide
QVQLVQSGSGVKKPGASVRVSCWTSEDIFERTELIHWVRQAPGQGLEWIGWVKTVTGAVNFGSPDFRQRVSLTRDRDLFTAHMDIRGLTQGDTATYFCAR

SEQ ID NO: 386 - protein, 98 aa, Homo sapiens; identical to SEQ ID NO: 324

SEQ ID NO: 387 - protein, 97 aa, Artificial Sequence; identical to SEQ ID NO: 381
  Description of Artificial Sequence: Synthetic polypeptide

SEQ ID NO: 388 - protein, 98 aa, Artificial Sequence; identical to SEQ ID NO: 362
  Description of Artificial Sequence: Synthetic polypeptide

SEQ ID NO: 389 - protein, 122 aa, Artificial Sequence
  Description of Artificial Sequence: Synthetic polypeptide
QVQLVQSGAAVKRPGASVTISCRASGYTFTTYYIHWVRQAPGQRLELMGMIDPSRGRTDYAQKFQGRVTMSRDTSTSTLYMELRSLRPDDTALYYCVRNVGTEGSLLHYDYWGQGTLVTVSS

SEQ ID NO: 390 - protein, 122 aa, Artificial Sequence
  Description of Artificial Sequence: Synthetic polypeptide
QVRLLQYGGGVKRPGASMTISCVASGYNFNDYYIHWVRQAPGQGLELMGWIDPSGGRTDYAGAFGDRVSMYRDKSMNTLYMDLRSLRSGDTAMYYCVRNVGTAGSLLHYDHWGLGVMVTVSS

SEQ ID NO: 391 - protein, 122 aa, Artificial Sequence
  Description of Artificial Sequence: Synthetic polypeptide
QVRLAQYGGGVKRLGATMTLSCVASGYTFNDYYIHWVRQAPGQGFELLGYIDPANGRPDYAGALRERLSFYRDKSMETLYMDLRSLRYDDTAMYYCVRNVGTAGSLLHYDHWGSGSPVIVSS

SEQ ID NO: 392 - protein, 122 aa, Artificial Sequence
  Description of Artificial Sequence: Synthetic polypeptide
QVQLVQSGGGVKRPGSTTTISCVASGYSFNDYYIHWVRQAPGQGLEVLGFIDPSNGRTNYAGAFGDRFSMYRDKSMETLYMDLRNLRSDDTAMYYCVRNVGTAGSLLHYDHWGTGSKIIVSS

SEQ ID NO: 393 - protein, 122 aa, Artificial Sequence
  Description of Artificial Sequence: Synthetic polypeptide
QVQLVQSGATVKKPRASVTLSCRTSGYNFIDYFIHWVRRAPGQRLEVMGYIDPSRGRPDYAPNFRDRVSLYRDTSMSIVYLDLRDLTPDDTAIYYCVRSEGTEGTVLHYDHWGPGTRVTVSP

SEQ ID NO: 394 - protein, 122 aa, Artificial Sequence
  Description of Artificial Sequence: Synthetic polypeptide
QVQLVQSGGTVKSPGTSVTLSCKTSGYNFIDYYIHWVRRAPGQRPELMGYIDPSHGRPDYEGKFRDRISLYRDTSTSVVYMDVRGLRLDDTALYYCVRGGGVEVSSNHYDHWGPGTMVFVSP

SEQ ID NO: 395 - protein, 122 aa, Artificial Sequence
  Description of Artificial Sequence: Synthetic polypeptide
QVQLVQSGAAVKRPGASVTISCRASGYTFTTYYIHWVRQAPGQGLELMGWINPRGGRTDYSYRFEDRVSMYRDTSMSIVYMDLRNLKSADTAVYYCVRNVGTSGSLLHYDFWGQGSLVTVSS

SEQ ID NO: 396 - protein, 5 aa, Artificial Sequence
  Description of Artificial Sequence: Synthetic peptide
  MOD_RES (3)..(3): Any amino acid
LPXTG

SEQ ID NO: 397 - DNA, 374 bp, Artificial Sequence
  Description of Artificial Sequence: Synthetic polynucleotide
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagatgtggcaacggaggggagcttactccactttgactactggggccagggaaccctggtcaccgtctcctcagcgtcgac

SEQ ID NO: 398 - DNA, 374 bp, Artificial Sequence
  Description of Artificial Sequence: Synthetic polynucleotide
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagacgtgggaacggaggggagtttactccactttgactactggggccagggaaccctggtcaccgtctcctcagcgtcgac

SEQ ID NO: 399 - DNA, 372 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggtggacgttcggccaagggaccaaggtggaaatcaaacgaactgtggctgcaccatctgtcttcatcttcccgccatctgatgagcaattg

SEQ ID NO: 400 - DNA, 372 bp, Artificial Sequence
  Description of Artificial Sequence: Synthetic polynucleotide
gaaattgtgttgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggtggacgttcggccaagggaccaaggtggaaatcaaacgaactgtggctgcaccatctgtcttcatcttcccgccatctgatgagcaattg

SEQ ID NO: 401 - protein, 122 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDVATEGSLLHFDYWGQGTLVTVSS

SEQ ID NO: 402 - protein, 122 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDVGTEGSLLHFDYWGQGTLVTVSS

SEQ ID NO: 403 - protein, 106 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYNNWWTFGQGTKVEIK

SEQ ID NO: 404 - protein, 106 aa, Artificial Sequence
  Description of Artificial Sequence: Synthetic polypeptide
EIVLTQSPATLSVSPGERATLSCRASQSVSSNLAWYQQKPGQAPRLLIYGASTRATGIPARFSGSGSGTEFTLTISSLQSEDFAVYYCQQYNNWWTFGQGTKVEIK

SEQ ID NO: 405 - protein, 647 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDYGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 406 - protein, 647 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNGKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDYGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 407 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDYGKNNTETFRPGGGNMKDNWRSELYKYKVVEVKPLGVAPTNARERVVEREKE

SEQ ID NO: 408 - protein, 815 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDYGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGGSGDIIKLLNEQVNKEMNSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 409 - protein, 647 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVCTQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRCMYAPPIAGNITCISNITGLLLTRDYGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 410 - protein, 647 aa, Artificial Sequence
  Description of Artificial Sequence: Synthetic polypeptide
MPMGSLQPLATLYLLGMLVASVLAAENLWVTVYYGVPVWKDAETTLFCASDAKAYEKKKRNVWATHCCVPTDPNPQEMVLKNVTENFNMWKNDMVDQMHTDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNKVKTIIVHLKESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQRVGQAMYAPPIAGNITCISNITGLLLTRDGYKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPECQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 411 - protein, 667 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIEGTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDYGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGGGSGLNDIFEAQKIEWHE

SEQ ID NO: 412 - protein, 647 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHCCVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDYGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPECQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 413 - DNA, 1973 bp, Artificial Sequence
  Description of Artificial Sequence: Synthetic polynucleotide
gtcgacaagcttcccgggccaccatgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaagaacgtgaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatcaacgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccactgccgcatcaagcagatcatcaacatgtggcaggaggtgggccgcgccatgtacgccccccccatcgccggcaacatcacctgcatctccaacatcaccggcctgctgctgacccgcgactacggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactagggatcc

SEQ ID NO: 414 - DNA, 1973 bp, Artificial Sequence
  Description of Artificial Sequence: Synthetic polynucleotide
gtcgacaagcttcccgggccaccatgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccgacaacggcaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatcaacgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccactgccgcatcaagcagatcatcaacatgtggcaggaggtgggccgcgccatgtacgccccccccatcgccggcaacatcacctgcatctccaacatcaccggcctgctgctgacccgcgactacggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactagggatcc

SEQ ID NO: 415 - DNA, 1507 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaagaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgactacggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtgaccgaattcgggacccggatcc

SEQ ID NO: 416 - DNA, 2480 bp, Artificial Sequence
  Description of Artificial Sequence: Synthetic polynucleotide
gtcgacaagcttcccgggccaccatgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaagaacgtgaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatcaacgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccactgccgcatcaagcagatcatcaacatgtggcaggaggtgggccgcgccatgtacgccccccccatcgccggcaacatcacctgcatctccaacatcaccggcctgctgctgacccgcgactacggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggacggcggcggctccggcgacatcatcaagctgctgaacgagcaggtgaacaaggagatgaactcctccaacctgtacatgtccatgtcctcctggtgctacacccactccctggacggcgccggcctgttcctgttcgaccacgccgccgaggagtacgagcacgccaagaagctgatcatcttcctgaacgagaacaacgtgcccgtgcagctgacctccatctccgcccccgagcacaagttcgagggcctgacccagatcttccagaaggcctacgagcacgagcagcacatctccgagtccatcaacaacatcgtggaccacgccatcaagtccaaggaccacgccaccttcaacttcctgcagtggtacgtggccgagcagcacgaggaggaggtgctgttcaaggacatcctggacaagatcgagctgatcggcaacgagaaccacggcctgtacctggccgaccagtacgtgaagggcatcgccaagtcccgcaagtcctagtaaggatcc

SEQ ID NO: 417 - DNA, 1973 bp, Artificial Sequence
  Description of Artificial Sequence: Synthetic polynucleotide
gtcgacaagcttcccgggccaccatgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgtgcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaagaacgtgaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatcaacgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccactgccgcatcaagcagatcatcaacatgtggcaggaggtgggccgctgcatgtacgccccccccatcgccggcaacatcacctgcatctccaacatcaccggcctgctgctgacccgcgactacggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactagggatcc

SEQ ID NO: 418 - DNA, 1965 bp, Artificial Sequence
  Description of Artificial Sequence: Synthetic polynucleotide
gtcgacgccaccatgcctatgggatctctgcagcctctggccacactgtacctgctgggaatgctggtggcttctgtgctggccgccgagaatctgtgggtcacagtgtactatggcgtgcccgtgtggaaggacgccgagacaacactgttttgtgccagcgacgccaaggcctacgagaagaaaaagcggaacgtgtgggccacacactgctgcgtgccaacagaccccaatcctcaagagatggtgctgaagaacgtgaccgagaacttcaacatgtggaagaacgacatggtggaccagatgcacaccgacgtgatcagcctgtgggaccagagcctgaagccttgcgtgaagctgacccctctgtgcgtgaccctgaactgcacaaatgccaccgccagcaacagcagcatcatcgagggcatgaagaactgcagcttcaacatcaccaccgagctgcgcgacaagcgcgagaagaagaacgccctgttctacaagctggacatcgtgcagctggacggcaacagctcccagtacagactgatcaactgcaacaccagcgtgatcacccaggcctgtcctaaggtgtccttcgatcccattcctatccactactgtgcccctgccggctacgccatcctgaagtgcaacaacaagaccttcaccggcacaggcccctgcaacaatgtgtccaccgtgcagtgtacccacggcatcaagcctgtggtgtctacccagctgctgctgaatggatctctggccgagggcgagatcatcatcagaagcgagaatatcaccaacaaggtcaagaccatcatcgtgcacctgaaggagagcgtgaagatcgagtgcacccggcctaacaacaaaacccggaccagcatcagaatcggccctggccagtggttttacgccaccggacaagtgatcggcgacatcagagaggcctactgcaacatcaacgagagcaagtggaacgagacactgcagcgggtgtccaagaagctgaaagagtacttccctcacaagaacatcaccttccagcctagctctggcggcgacctggaaatcaccacacacagcttcaattgtggcggcgagttcttctactgcaatacctccagcctgttcaaccggacctacatggccaactccaccgatatggccaacagcaccgagacaaacagcaccagaaccatcaccatccactgccggatcaagcagatcatcaatatgtggcagcgcgtcggccaggctatgtacgctcctcctatcgccggcaacatcacatgcatcagcaatatcaccggcctgctgctcaccagagatggctacaagaacaacaccgaaaccttcagacccggcggaggcaacatgaaggacaattggagaagcgagctgtacaagtacaaggtggtcaagatcgagcccctgggcgtcgcacctacacggtgcaagagaagagtcgtgggccgtcgtagaaggcggagagccgttggaattggcgccgtgttcctgggctttctgggagccgctggatctacaatgggcgctgccagcatgaccctgacagtgcaggctagaaatctgctgagcggcattgtgcagcagcagagcaacctgctgagagcccctgagtgtcagcagcacctcctgaaactgaccgtgtggggaatcaagcagctgcaggcaagagtgctggctgtggaaagatacctgcgggaccagcagctcctcggcatctggggatgttctggcaagctgatctgctgcaccaacgtgccctggaacagctcctggtccaacagaaacctgagcgagatctgggacaacatgacctggctgcagtgggacaaagagatcagcaactacacccagatcatctacggactgctggaagagagccagaaccagcaagagaaaaacgagcaggacctgctggccctggactgataaggatcc

SEQ ID NO: 419 - DNA, 2024 bp, Artificial Sequence
  Description of Artificial Sequence: Synthetic polynucleotide
tctagaccaccatgcccatgggcagcctgcagcccctggccaccctgtacctgctgggcatgctggtggctagcgtgctggccgccgagaacctgtgggtgaccgtctactatggcgtgcccgtctggaaggaagccaaaaccacactgttctgcgctagcgacgctaaggcatacgagaaaaaagtgcacaatgtctgggctactcatgcatgcgtgcctaccgatccaaatccccaggagatggtgctgaagaacgtcacagaaaactttaatatgtggaagaacgacatggtggatcagatgcacgaggacgtgatcagcctgtgggatcagtccctgaagccatgcgtgaaactgactcccctgtgcgtcaccctgaactgtactaatgccaccgcttccaacagctccatcattgaggggatgaagaactgttctttcaatatcactaccgagctgcgcgacaagcgagaaaagaaaaatgccctgttttacaaactggacatcgtgcagctggatggcaactctagtcagtatagactgattaactgcaatacaagcgtgatcactcaggcatgtccaaaggtcagtttcgatcctattccaatccactactgcgcacccgccggatatgctatcctgaagtgtaacaacaagaccttcaccggcactgggccttgcaacaacgtgagcaccgtccagtgtacacatggcattaagccagtggtcagcacccagctgctgctgaacggcagcctggcagagggcgaaatcattatccgcagcgagaacatcacaaataatgtgaagactatcatcgtccacctgaacgagagcgtgaagattgaaggcacacggcccaacaacaagaccaggacatccattcgcatcggacctggccagtggttctacgctactggccaggtcatcggggacatcagagaggcctattgtaacatcaatgagtcaaagtggaatgaaactctgcagagggtgagcaagaaactgaaggaatacttccctcacaaaaacatcacctttcagccatcaagcggcggggacctggagattacaactcattctttcaattgcggaggcgaattcttttactgtaacacctcctctctgtttaatcgcacatatatggctaacagtactgatatggcaaactctactgagaccaatagtacacgaactattaccatccattgccggatcaagcagattatcaacatgtggcaggaagtggggcgggccatgtatgctccccctattgcaggaaatattacctgtatcagcaacattaccggcctgctgctgacaagagactatggaaagaacaatacagagacttttaggcctggcgggggaaacatgaaagataattggcgctccgagctgtacaagtataaagtggtcaagatcgaaccactgggagtggcacctacccgatgtaaacggagagtggtcggaaggcgccgacggagaagggcagtgggaatcggagccgtcttcctgggctttctgggagcagctggcagcacaatgggagcagcctctatgaccctgacagtgcaggctcgaaatctgctgagtgggatcgtgcagcagcagtcaaacctgctgcgagcaccagaggcacagcagcatctgctgaagctgaccgtgtggggcatcaagcagctgcaggccagagtgctggctgtcgaacggtacctgagagatcagcagctgctgggaatctggggatgcagcggaaagctgatttgctgtacaaacgtgccctggaatagttcatggtcaaacaggaatctgagcgagatctgggacaatatgacctggctgcagtgggataaggaaatcagtaactacacacagatcatctatggcctgctggaggaatcacagaaccagcaggagaaaaatgaacaggacctgctggccctggatggcggcggcggcagcggactgaacgacatcttcgaggcccagaagatcgagtggcacgagtgatgaggatcc

SEQ ID NO: 420 - DNA, 1973 bp, Artificial Sequence
  Description of Artificial Sequence: Synthetic polynucleotide
gtcgacaagcttcccgggccaccatgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccactgctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaagaacgtgaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatcaacgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccactgccgcatcaagcagatcatcaacatgtggcaggaggtgggccgcgccatgtacgccccccccatcgccggcaacatcacctgcatctccaacatcaccggcctgctgctgacccgcgactacggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgagtgccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactagggatcc

SEQ ID NO: 421 - protein, 647 aa, Artificial Sequence; identical to SEQ ID NO: 242
  Description of Artificial Sequence: Synthetic polypeptide

SEQ ID NO: 422 - protein, 817 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDYGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 423 - protein, 637 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDYGKNNTETFRPGGGNMKDNWRSELYKYKVVEVKPLGVAPTNARERVVEREKEAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIK

SEQ ID NO: 424 - protein, 465 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDYGKNNTETFRPGGGNMKDNWRSELYKYKVVEVKPLGVAPTNARERVVEREKE

SEQ ID NO: 425 - protein, 623 aa, Artificial Sequence
  Description of Artificial Sequence: Synthetic polypeptide
AENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDYGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 426 - protein, 623 aa, Artificial Sequence
  Description of Artificial Sequence: Synthetic polypeptide
AENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDYGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 427 - protein, 817 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDYGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 428 - protein, 637 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDYGKNNTETFRPGGGNMKDNWRSELYKYKVVEVKPLGVAPTNARERVVEREKEAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIK

SEQ ID NO: 429 - protein, 465 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDYGKNNTETFRPGGGNMKDNWRSELYKYKVVEVKPLGVAPTNARERVVEREKE

SEQ ID NO: 430 - protein, 623 aa, Artificial Sequence
  Description of Artificial Sequence: Synthetic polypeptide
AENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNGKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDYGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 431 - protein, 623 aa, Artificial Sequence
  Description of Artificial Sequence: Synthetic polypeptide
AENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDYGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 432 - protein, 817 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNNSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDYGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 433 - protein, 637 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNNSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDYGKNNTETFRPGGGNMKDNWRSELYKYKVVEVKPLGVAPTNARERVVEREKEAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIK

SEQ ID NO: 434 - protein, 465 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNNSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDYGKNNTETFRPGGGNMKDNWRSELYKYKVVEVKPLGVAPTNARERVVEREKE

SEQ ID NO: 435 - protein, 623 aa, Artificial Sequence
  Description of Artificial Sequence: Synthetic polypeptide
AENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNNSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQWFYATGQVIGDIRKAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDYGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 436 - protein, 623 aa, Artificial Sequence
  Description of Artificial Sequence: Synthetic polypeptide
AENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNNSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDYGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 437 - protein, 820 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPSNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRNITIHCRIKQIINMWQEVGRAMYAPPIAGNITCISNITGLLLTRDYGKNDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFILGICRAIRNIPTRIRQGFETALL

SEQ ID NO: 438 - protein, 640 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPSNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRNITIHCRIKQIINMWQEVGRAMYAPPIAGNITCISNITGLLLTRDYGKNDTETFRPGGGNMKDNWRSELYKYKVVEVKPLGVAPTNARERVVEREKEAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIK

SEQ ID NO: 439 - protein, 468 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPSNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRNITIHCRIKQIINMWQEVGRAMYAPPIAGNITCISNITGLLLTRDYGKNDTETFRPGGGNMKDNWRSELYKYKVVEVKPLGVAPTNARERVVEREKE

SEQ ID NO: 440 - protein, 626 aa, Artificial Sequence
  Description of Artificial Sequence: Synthetic polypeptide
AENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPSNKTRTSIRIGPGQWFYATGQVIGDIREAYCNISESKWNETLQRVSKKLKEYFPHKNITFQPSSGGDLEITTHSFNCGGEFFYCNTSSLFNRTYMANSTDMANSTETNSTRNITIHCRIKQIINMWQEVGRAMYAPPIAGNITCISNITGLLLTRDYGKNDTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 441 - protein, 626 aa, Artificial Sequence
  Description of Artificial Sequence: Synthetic polypeptide
AENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPSNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRNITIHCRIKQIINMWQEVGRAMYAPPIAGNITCISNITGLLLTRDYGKNDTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 442 - protein, 828 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDYGKNTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 443 - protein, 648 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDYGKNTRDGGKNNTETFRPGGGNMKDNWRSELYKYKVVEVKPLGVAPTNARERVVEREKEAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIK

SEQ ID NO: 444 - protein, 476 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDYGKNTRDGGKNNTETFRPGGGNMKDNWRSELYKYKVVEVKPLGVAPTNARERVVEREKE

SEQ ID NO: 445 - protein, 634 aa, Artificial Sequence
  Description of Artificial Sequence: Synthetic polypeptide
AENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQWFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDYGKNTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 446 - protein, 634 aa, Artificial Sequence
  Description of Artificial Sequence: Synthetic polypeptide
AENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDYGKNTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 447 - protein, 829 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLTPCVKLTPLCVTLNCTDANDTASNSSIIKGMNNSIVGEMKNCSFNITTELRDKREKKNALFYKLDIVQLDGNSSEYRLINCNTSVITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIRIGPGQAFYATGQVIGDIRKAHCNISESKWNETLQRVSKKLKEYFPDKNITFQPSSGGDPEITTHSFNCGGEFFYCNTSSLFNRTYMANSTDMANSAETNSTRTITLHCRIKQIINMWQEVGRAMYAPPIAGNITCISNITGLLLTRDYGNSSTETETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLRLTVWGIKQLQARVLALERYLKDQQLLGMWGCSGKLICTTNVYWNSSWSNKTYDDIWDNMTWMQWEGEISNYTNIIYDLLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRKRSTRLVSGFLALVWDDLRSLCLFLYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 448 - protein, 649 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLTPCVKLTPLCVTLNCTDANDTASNSSIIKGMNNSIVGEMKNCSFNITTELRDKREKKNALFYKLDIVQLDGNSSEYRLINCNTSVITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIRIGPGQAFYATGQVIGDIRKAHCNISESKWNETLQRVSKKLKEYFPDKNITFQPSSGGDPEITTHSFNCGGEFFYCNTSSLFNRTYMANSTDMANSAETNSTRTITLHCRIKQIINMWQEVGRAMYAPPIAGNITCISNITGLLLTRDYGNSSTETETFRPGGGNMKDNWRSELYKYKVVEVKPLGVAPTNARERVVEREKEAVGMGAVFLGFLGAAGSTMGAASITLTVQARQLLSGIVQQQSNLLKAIEAQQHMLRLTVWGIKQLQARVLALERYLKDQQLLGMWGCSGKLICTTNVYWNSSWSNKTYDDIWDNMTWMQWEGEISNYTNIIYDLLEESQNQQEKNEQDLLALDRWNSLWNWFNITNWLWYIK

SEQ ID NO: 449 - protein, 477 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLTPCVKLTPLCVTLNCTDANDTASNSSIIKGMNNSIVGEMKNCSFNITTELRDKREKKNALFYKLDIVQLDGNSSEYRLINCNTSVITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIRIGPGQAFYATGQVIGDIRKAHCNISESKWNETLQRVSKKLKEYFPDKNITFQPSSGGDPEITTHSFNCGGEFFYCNTSSLFNRTYMANSTDMANSAETNSTRTITLHCRIKQIINMWQEVGRAMYAPPIAGNITCISNITGLLLTRDYGNSSTETETFRPGGGNMKDNWRSELYKYKVVEVKPLGVAPTNARERVVEREKE

SEQ ID NO: 450 - protein, 635 aa, Artificial Sequence
  Description of Artificial Sequence: Synthetic polypeptide
AENLWVTVYYGVPVWKEAKTTLFCASDAKAYEKKVHNVWATHACVPTDPNPQEMVLKNVTENFNMWKNDMVDQMHEDVISLWDQSLTPCVKLTPLCVTLNCTDANDTASNSSIIKGMNNSIVGEMKNCSFNITTELRDKREKKNALFYKLDIVQLDGNSSEYRLINCNTSVITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIRIGPGQWFYATGQVIGDIRKAHCNISESKWNETLQRVSKKLKEYFPDKNITFQPSSGGDPEITTHSFNCGGEFFYCNTSSLFNRTYMANSTDMANSAETNSTRTITLHCRIKQIINMWQEVGRAMYAPPIAGNITCISNITGLLLTRDYGNSSTETETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 451 - protein, 657 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVHNVWATHACVPTDPNPQEMVLKNVTENFNMWKNDMVDQMHEDVISLWDQSLTPCVKLTPLCVTLNCTDANDTASNSSIIKGMNNSIVGEMKNCSFNITTELRDKREKKNALFYKLDIVQLDGNSSEYRLINCNTSVITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIRIGPGQAFYATGQVIGDIRKAHCNISESKWNETLQRVSKKLKEYFPDKNITFQPSSGGDPEITTHSFNCGGEFFYCNTSSLFNRTYMANSTDMANSAETNSTRTITLHCRIKQIINMWQEVGRAMYAPPIAGNITCISNITGLLLTRDYGNSSTETETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 452 - protein, 817 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDYGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 453 - protein, 637 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDYGKNNTETFRPGGGNMKDNWRSELYKYKVVEVKPLGVAPTNARERVVEREKEAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIK

SEQ ID NO: 454 - protein, 465 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDYGKNNTETFRPGGGNMKDNWRSELYKYKVVEVKPLGVAPTNARERVVEREKE

SEQ ID NO: 455 - protein, 623 aa, Artificial Sequence
  Description of Artificial Sequence: Synthetic polypeptide
AENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDYGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 456 - protein, 623 aa, Artificial Sequence
  Description of Artificial Sequence: Synthetic polypeptide
AENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDYGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 457 - protein, 830 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDYGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 458 - protein, 650 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDYGKNNTETFETFRPGGGNMKDNWRSELYKYKVVEVKPLGVAPTNARERVVEREKEAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIK

SEQ ID NO: 459 - protein, 478 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDYGKNNTETFETFRPGGGNMKDNWRSELYKYKVVEVKPLGVAPTNARERVVEREKE

SEQ ID NO: 460 - protein, 636 aa, Artificial Sequence
  Description of Artificial Sequence: Synthetic polypeptide
AENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQWFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDYGKNNTETFETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 461 - protein, 636 aa, Artificial Sequence
  Description of Artificial Sequence: Synthetic polypeptide
AENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDYGKNNTETFETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 462 - protein, 613 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPSNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRNITIHCRIKQIINMWQEVGRAMYAPPIAGNITCISNITGLLLTRDYGKNDTETFRPGGGNMKDNWRSELYKYKVVEVKPLGVAPTNARRRVVEREKRAVGIGAVFLGFLGAAGSTMGAASITLTVQARNLLSGIVQQQSNLLKAEAQQHLLKLTVWGIKQLQARVLALERYLKDQQLLGIWGCSGKLICTNVWNSSWSNKDIWDNMTWLQWDKEISNYTIIYLLEESQNQQEKNEQDLLALD

SEQ ID NO: 463 - protein, 622 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLTPCVKLTPLCVTLNCTDANDTASNSSIIKGMNNSIVGEMKNCSFNITTELRDKREKKNALFYKLDIVQLDGNSSEYRLINCNTSVITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIRIGPGQAFYATGQVIGDIRKAHCNISESKWNETLQRVSKKLKEYFPDKNITFQPSSGGDPEITTHSFNCGGEFFYCNTSSLFNRTYMANSTDMANSAETNSTRTITLHCRIKQIINMWQEVGRAMYAPPIAGNITCISNITGLLLTRDYGNSSTETETFRPGGGNMKDNWRSELYKYKVVEVKPLGVAPTNARRRVVEREKRAVGIGAVFLGFLGAAGSTMGAASITLTVQARNLLSGIVQQQSNLLKAEAQQHLLKLTVWGIKQLQARVLALERYLKDQQLLGIWGCSGKLICTNVWNSSWSNKDIWDNMTWLQWDEISNYTNIIYLLEESQNQQEKNEQDLLALD

SEQ ID NO: 464 - protein, 623 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDYGKNNTETFETFRPGGGNMKDNWRSELYKYKVVEVKPLGVAPTNARRRVVEREKRAVGIGAVFLGFLGAAGSTMGAASITLTVQARNLLSGIVQQQSNLLKAEAQQHLLKLTVWGIKQLQARVLALERYLKDQQLLGIWGCSGKLICTNVWNSSWSNKDIWDNMTWLQWDKEISNYTIIYLLEESQNQQEKNEQDLLALD

SEQ ID NO: 465 - protein, 610 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDYGKNNTETFRPGGGNMKDNWRSELYKYKVVEVKPLGVAPTNARRRVVEREKRAVGIGAVFLGFLGAAGSTMGAASITLTVQARNLLSGIVQQQSNLLKAEAQQHLLKLTVWGIKQLQARVLALERYLKDQQLLGIWGCSGKLICTNVWNSSWSNKDIWDNMTWLQWDKEISNYTIIYLLEESQNQQEKNEQDLLALD

SEQ ID NO: 466 - protein, 610 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDYGKNNTETFRPGGGNMKDNWRSELYKYKVVEVKPLGVAPTNARRRVVEREKRAVGIGAVFLGFLGAAGSTMGAASITLTVQARNLLSGIVQQQSNLLKAEAQQHLLKLTVWGIKQLQARVLALERYLKDQQLLGIWGCSGKLICTNVWNSSWSNKDIWDNMTWLQWDKEISNYTIIYLLEESQNQQEKNEQDLLALD

SEQ ID NO: 467 - protein, 610 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNNSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDYGKNNTETFRPGGGNMKDNWRSELYKYKVVEVKPLGVAPTNARRRVVEREKRAVGIGAVFLGFLGAAGSTMGAASITLTVQARNLLSGIVQQQSNLLKAEAQQHLLKLTVWGIKQLQARVLALERYLKDQQLLGIWGCSGKLICTNVWNSSWSNKDIWDNMTWLQWDKEISNYTIIYLLEESQNQQEKNEQDLLALD

SEQ ID NO: 468 - protein, 621 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDYGKNTRDGGKNNTETFRPGGGNMKDNWRSELYKYKVVEVKPLGVAPTNARRRVVEREKRAVGIGAVFLGFLGAAGSTMGAASITLTVQARNLLSGIVQQQSNLLKAEAQQHLLKLTVWGIKQLQARVLALERYLKDQQLLGIWGCSGKLICTNVWNSSWSNKDIWDNMTWLQWDKEISNYTIIYLLEESQNQQEKNEQDLLALD

SEQ ID NO: 469 - protein, 610 aa, Artificial Sequence
  Description of Artificial Sequence: Synthetic polypeptide
MWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDYGKNNTETFRPGGGNMKDNWRSELYKYKVVEVKPLGVAPTNARRRVVEREKRAVGIGAVFLGFLGAAGSTMGAASITLTVQARNLLSGIVQQQSNLLKAEAQQHLLKLTVWGIKQLQARVLALERYLKDQQLLGIWGCSGKLICTNVWNSSWSNKDIWDNMTWLQWDKEISNYTIIYLLEESQNQQEKNEQDLLALD

SEQ ID NO: 470 - DNA, 2457 bp, Artificial Sequence
  Description of Artificial Sequence: Synthetic polynucleotide
atgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaagaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgactacggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggtgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtgatga

SEQ ID NO: 471 - DNA, 2544 bp, Artificial Sequence
  Description of Artificial Sequence: Synthetic polynucleotide
atgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgactacggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggtgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaa

SEQ ID NO: 472 - DNA, 2457 bp, Artificial Sequence
  Description of Artificial Sequence: Synthetic polynucleotide
atgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaacaactccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacgtccatccggatcggccctggccaggccttctacgccaccggccaggtgatcggcgacatccgcaaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgactacggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggtgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtgatga

SEQ ID NO: 473 - DNA, 2467 bp, Artificial Sequence
  Description of Artificial Sequence: Synthetic polynucleotide
atgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgacaagaccatcatcgtgcacctgaacgagtccgtgaagatcgagtgcacccgcccgagcaacaagacgcgcacctccatccggatcggccctggccaggccttctacgccaccggccaggtgatcggcgacatccgcgaggcgtactgcaacatcagcgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaacatcacgatccactgccgcatcaagcagatcatcaacatgtggcaggaggtgggccgcgccatgtacgcaccgcccatcgccggcaacatcacctgcatctccaacatcaccggcctcctgctgacccgcgactacggcaagaacgacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccgsgacaggcccggtggcatcgaggaggagggcggcgagcaggaccgcaaccgctccacgcgcctggtgtccggcttcctggccctggtgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcatcctgggcatctgccgcgccatccgcaacatccccacccgcatccgccagggcttcgagaccgccctcctgtgatga

SEQ ID NO: 474 - DNA, 2490 bp, Artificial Sequence
  Description of Artificial Sequence: Synthetic polynucleotide
atgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcagcgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgactacggcaagaacacgagggacggaggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggcgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtgatga

SEQ ID NO: 475 - DNA, 2493 bp, Artificial Sequence
  Description of Artificial Sequence: Synthetic polynucleotide
atgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgacgccctgcgtgaagctgaccccgctgtgcgtgaccctgaactgcacggacgccaacgacaccgcgtcgaacagctccatcatcaaggggatgaacaactccatcgtgggggagatgaagaactgctccttcaacatcacgacggagctgcgcgacaagcgcgagaagaagaacgccctgttctacaagctggacatcgtgcagctggacggcaactcctcggagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacgcgaagaccatcatcgtgcacctgaacgagtccgtgaagatcgagtgcacccgcccgagcaacaacacgcgcacctccatccggatcggccctggccaggccttctacgccaccggccaggtgatcggcgacatccgcaaggcgcactgcaacatctccgagtccaagtggaacgagaccctgcagcgcgtgtccaagaagctgaaggagtacttccccgacaagaacatcaccttccagccgtcgtccggcggcgaccccgagatcaccacgcactccttcaactgcggtggcgagttcttctactgcaacacgtcgtccctgttcaaccgcacctacatggccaactcgacggacatggcgaactccgcggagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgactacggcaactccagcacggagacggagaccttcaggccagggggaggcaacatgaaggacaactggcgctccgagctgtacaagtacaaggtggtggaggtgaagcccctgggcgtggcacccaccaacgcccgcaggcgcgtggtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgcggctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacgacgacatctgggacaacatgacctggatgcagtgggagggggagatctccaactacaccaacatcatctacgacctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcggatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaagcgctccacgcgcctggtgtccggcttcctggccctggtgtgggacgacctgcgctccctgtgcctgttcctctaccaccgcctgcgcgacttcatcctgatcgcggcccgcgctggcgagctgctgggccggtcctcgctgaagggcctgcgccgcggctgggaggccctgaagtacctgggcagcctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaa

SEQ ID NO: 476 - DNA, 2454 bp, Artificial Sequence
  Description of Artificial Sequence: Synthetic polynucleotide
atgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgactacggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggtgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtag

SEQ ID NO: 477 - DNA, 2493 bp, Artificial Sequence
  Description of Artificial Sequence: Synthetic polynucleotide
atgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgaacgccaccgcgtccaactcctctatcatcgaggggatgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctcggagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacgtccaccgacatggccaactccaccgagaccaactccacgcgcatcatcacgatccggtgccgcatcaagcagatcatcaacatgtggcaggaggtgggccgcgccatgtacgcaccgcccatcgccggcaacatcacctgcatctccaacatcaccggcctcctgctgacccgcgactacggcaagaacaacacggagaccttcgagacgttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggcgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtag

What is claimed is:

1. A recombinant HIV-1 envelope polypeptide comprising HIV-1 envelope CH505 M5 with a mutation of the amino acid at position 458, wherein the HIV-1 envelope CH505 M5 polypeptide is:
   a gp120 envelope comprising SEQ ID NO:424,
   a gp120 delta 8 envelope comprising all the consecutive amino acids immediately after the signal peptide sequence MRVMGIQRNYPQWWIWSMLGFWMLMICNG of SEQ ID NO:407,
   a gp140 envelope comprising SEQ ID NO:423,
   a gp140 envelope comprising all the consecutive amino acids immediately after the signal peptide sequence MPMGSLQPLATLYLLGMLVASVLA of CH505M-5chim.6R.SOSIP.664v4.1_G458Y (SEQ ID NO:405),
   a gp140 envelope comprising all the consecutive amino acids immediately after the signal peptide sequence MPMGSLQPLATLYLLGMLVASVLA of CH505M-5chim.6R.SOSIP.664v4.1 ferritin_G458Y (SEQ ID NO:408),
   a gp140 envelope comprising all the consecutive amino acids immediately after the signal peptide sequence MPMGSLQPLATLYLLGMLVASVLA of CH505M-5chim.6R.DS.SOSIP.664(SEQ ID NO:409),
   a gp140 envelope comprising all the consecutive amino acids immediately after the signal peptide sequence MPMGSLQPLATLYLLGMLVASVLA of CH505M5chim.6R.SOSIP.664v5.2.8_G458Y (SEQ ID NO:410), a gp140 envelope comprising all the consecutive amino acids immediately after the signal peptide sequence MPMGSLQPLATLYLLGMLVASVLA of CH505M5chim.6R.SOSIP.664v4.1avi_G458Y (SEQ ID NO:411), a gp140 envelope comprising all the consecutive amino acids immediately after the signal peptide sequence MPMGSLQPLATLYLLGML-VASVLA of CH505M5chim.6R.SOSIP.664v4.1.1_G458Y (SEQ ID NO:412),
   a gp140 envelope comprising the amino acid sequence of CH505M5chim.6R.SOSIP.664_G458Y (SEQ ID NO:426),
   a gp140 envelope comprising all the consecutive amino acids immediately after the signal peptide sequence MPMGSLQPLATLYLLGMLVASVLA of CH505M5chim.6R.SOSIP.664v4.2 (SEQ ID NO:243),
   a gp145 envelope comprising all the consecutive amino acids immediately after the signal peptide sequence MRVMGIQRNYPQWWIWSMLGFWMLMICNG of SEQ ID NO:187, or
   a gp160 envelope comprising SEQ ID NO:422;
   wherein the amino acid at position 458 is a tyrosine (Y), a phenylalanine (F), a tryptophan (W), an arginine (R), a cysteine (C), a leucine (L), a lysine (K), a serine (S), an aspartic acid (D), a glutamic acid (E), a methionine (M), a glutamine (Q), a histidine (H), or an asparagine (N).

2. The recombinant HIV-1 envelope polypeptide of claim 1, wherein the HIV-1 envelope CH505 M5 polypeptide is a gp140 HIV-1 CH505 M5 polypeptide comprising:

all the consecutive amino acids immediately after the signal peptide sequence MPMGSLQPLAT-LYLLGMLVASVLA of CH505M5chim.6R.SOSIP.664v4.1_G458Y (SEQ ID NO:405), all the consecutive amino acids immediately after the signal peptide sequence MPMGSLQPLAT-LYLLGMLVASVLA of CH505M5chim.6R.SOSIP.664v4.1 ferritin_G458Y (SEQ ID NO:408), all the consecutive amino acids immediately after the signal peptide sequence MPMGSLQPLAT-LYLLGMLVASVLA of CH505M5chim.6R.DS.SOSIP.664(SEQ ID NO:409), all the consecutive amino acids immediately after the signal peptide sequence MPMGSLQPLAT-LYLLGMLVASVLA of CH505M5chim.6R.SOSIP.664v5.2.8_G458Y (SEQ ID NO:410), all the consecutive amino acids immediately after the signal peptide sequence MPMGSLQPLAT-LYLLGMLVASVLA of CH505M5chim.6R.SOSIP.664v4.1avi_G458Y (SEQ ID NO:411), all the consecutive amino acids immediately after the signal peptide sequence MPMGSLQPLAT-LYLLGMLVASVLA of CH505M5chim.6R.SOSIP.664v4.1.1_G458Y (SEQ ID NO:412), the amino acid sequence of CH505M5chim.6R.SOSIP.664_G458Y (SEQ ID NO:426), or all the consecutive amino acids immediately after the signal peptide sequence MPMGSLQPLAT-LYLLGMLVASVLA of CH505M5chim.6R.SOSIP.664v4.2 (SEQ ID NO:243), wherein the amino acid at position 458 is a tyrosine.

3. A recombinant HIV-1 envelope polypeptide of claim 1, wherein the recombinant HIV-1 envelope polypeptide is enriched for Man5 glycoforms of N-linked glycans.

4. A nucleic acid encoding the recombinant HIV-1 envelope polypeptide of claim 1.

5. A recombinant trimer comprising three identical recombinant HIV-1 envelope polypeptides from claim 2.

6. An immunogenic composition comprising the recombinant trimer of claim 5 and a carrier.

7. An immunogenic composition comprising the nucleic acid of claim 4 and a carrier.

8. The composition of claim 6, further comprising an adjuvant.

9. The nucleic acid of claim 4, wherein the nucleic acid is operably linked to a promoter inserted in an expression vector.

10. A method of inducing an immune response in a subject, the method comprising administering a composition in an amount sufficient to induce an immune response, wherein the composition comprises:
one or more of the recombinant HIV-1 envelope CH505 M5 polypeptides of claim 1, wherein the amino acid at position 458 is a tyrosine (Y);
a nucleic acid encoding one or more of the HIV-1 envelope CH505 M5 polypeptides of claim 1, wherein the nucleic acid encodes a tyrosine (Y) at amino acid position 458; or
any combination thereof.

11. The method of claim 10, wherein one or more of the recombinant HIV-1 envelope CH505 M5 G458Y polypeptides is enriched for Man5 glycoforms of N-linked glycans.

12. The method of claim 10, further comprising administering a composition comprising one or more recombinant HIV-1 envelope polypeptides comprising HIV-1 envelope CH505 M5, a nucleic acid encoding one or more of the HIV-1 envelope polypeptides CH505 M5, or any combination thereof, wherein the HIV-1 envelope CH505 M5 polypeptide is:
a gp120 delta 8 envelope comprising all the consecutive amino acids immediately after the signal peptide sequence MRVMGIQRNYPQWWIWSMLGFW-MLMICNG of SEQ ID NO:151,
a gp160 sequence comprising all the consecutive amino acids immediately after the signal peptide sequence MRVMGIQRNYPQWWIWSMLGFWMLMICNG of SEQ ID NO:163, or
a gp145 sequence comprising all the consecutive amino acids immediately after the signal peptide sequence MRVMGIQRNYPQWWIWSMLGFWMLMICNG of SEQ ID NO:187.

13. The method of claim 12, wherein one or more of the recombinant HIV-1 envelope CH505 M5 polypeptides is enriched for Man5 glycoforms of N-linked glycans.

14. The method of claim 12, further comprising administering a composition comprising a recombinant HIV-1 envelope CH505 T/F polypeptide, a nucleic acid encoding one or more of the HIV-1 envelope polypeptides CH505 T/F, or any combination thereof, wherein the HIV-1 envelope CH505 TF polypeptide comprises:
all the consecutive amino acids immediately after the signal peptide sequence MPMGSLQPLAT-LYLLGMLVASVLA in CH505TFchim.6R.SOSIP.664 (SEQ ID NO:234),
all the consecutive amino acids immediately after the signal peptide sequence MPMGSLQPLAT-LYLLGMLVASVLA in CH505TFchim.6R.DS.SOSIP.664 (SEQ ID NO:238),
all the consecutive amino acids immediately after the signal peptide sequence MPMGSLQPLAT-LYLLGMLVASVLA in CH505TFchim.6R.SOSIP.664V4.1 (SEQ ID NO:260)
all the consecutive amino acids immediately after the signal peptide sequence MPMGSLQPLAT-LYLLGMLVASVLA in CH505TFchim.6R.SOSIP.664V4.2 (SEQ ID NO:261).

15. The method of claim 14, wherein one or more of the recombinant HIV-1 envelope CH505 T/F polypeptides is enriched for Man5 glycoforms of N-linked glycans.

16. The method of claim 10, wherein the composition further comprises a carrier.

17. The method of claim 10, wherein the composition further comprises an adjuvant.

18. The method of claim 10, further comprising administering an agent which modulates host immune tolerance.

19. The method of claim 10, wherein the polypeptide administered is multimerized in a liposome or nanoparticle.

20. The method of claim 10, wherein the polypeptide administered is in the form of a recombinant trimer comprising three identical recombinant HIV-1 envelope polypeptides.

* * * * *